US008541220B2

(12) United States Patent
Weiner et al.

(10) Patent No.: US 8,541,220 B2
(45) Date of Patent: Sep. 24, 2013

(54) ISOMERASES, NUCLEIC ACIDS ENCODING THEM AND METHODS FOR MAKING AND USING THEM

(75) Inventors: David P. Weiner, San Diego, CA (US); Ellen G. Burke, San Diego, CA (US); Peter Luginbuhl, San Diego, CA (US); Analia Bueno, San Diego, CA (US); Joslin M. Cuenca, San Diego, CA (US); Mervyn L. De Souza, Ft. Collins, CO (US); Sherry Kollmann, Rogers, MN (US)

(73) Assignee: Verenium Corporation, San Diego, CA (US)

( * ) Notice: Subject to any disclaimer, the term of this patent is extended or adjusted under 35 U.S.C. 154(b) by 231 days.

(21) Appl. No.: 12/810,067

(22) PCT Filed: Dec. 22, 2008

(86) PCT No.: PCT/US2008/088066
§ 371 (c)(1),
(2), (4) Date: Sep. 30, 2010

(87) PCT Pub. No.: WO2009/088753
PCT Pub. Date: Jul. 16, 2009

(65) Prior Publication Data
US 2011/0053245 A1 Mar. 3, 2011

Related U.S. Application Data

(60) Provisional application No. 61/018,880, filed on Jan. 3, 2008.

(51) Int. Cl.
| C12N 9/90 | (2006.01) |
| C12N 9/88 | (2006.01) |
| C12N 9/48 | (2006.01) |
| C12N 9/42 | (2006.01) |
| C12N 9/16 | (2006.01) |
| C02F 3/34 | (2006.01) |
| A62D 3/00 | (2007.01) |
| C07H 21/04 | (2006.01) |
| C07K 1/00 | (2006.01) |
| A21D 2/00 | (2006.01) |
| A23L 1/10 | (2006.01) |
| D21C 3/20 | (2006.01) |

(52) U.S. Cl.
USPC .......... 435/233; 435/232; 435/212; 435/209; 435/200; 435/196; 435/193; 435/192; 435/262; 435/262.5; 536/23.2; 530/350; 162/72

(58) Field of Classification Search
USPC ................ 435/233, 232, 212, 209, 200, 196, 435/193, 192, 262, 262.5; 426/20, 29; 536/23.2; 530/350; 162/72
See application file for complete search history.

(56) References Cited

FOREIGN PATENT DOCUMENTS
| WO | 2005063037 | 7/2005 |
| WO | 2006096527 | 9/2006 |

OTHER PUBLICATIONS

Broun et al., Catalytic plasticity of fatty acid modification enzymes underlying chemical diversity of plant lipids. Science, 1998, vol. 282: 1315-1317.*
Chica et al., Semi-rational approaches to engineering enzyme activity: combining the benefits of directed evolution and rational design. Curr. Opi. Biotechnol., 2005, vol. 16: 378-384.*
Devos et al., Practical limits of function prediction. Proteins: Structure, Function, and Genetics. 2000, vol. 41: 98-107.*
Seffernick et al., Melamine deaminase and Atrazine chlorohydrolase: 98 percent identical but functionally different. J. Bacteriol., 2001, vol. 183 (8): 2405-2410.*
Sen et al., Developments in directed evolution for improving enzyme functions. Appl. Biochem. Biotechnol., 2007, vol. 143: 212-223.*
Whisstock et al., Prediction of protein function from protein sequence. Q. Rev. Biophysics., 2003, vol. 36 (3): 307-340.*
Wishart et al., A single mutation converts a novel phosphotyrosine binding domain into a dual-specificity phosphatase. J. Biol. Chem., 1995, vol. 270(45): 26782-26785.*
Witkowski et al., Conversion of b-ketoacyl synthase to a Malonyl Decarboxylase by replacement of the active cysteine with glutamine. Biochemistry, 1999, vol. 38: 11643-11650.*
EP08870439.0—Extended EP Search Report & Opinion (Jun. 17, 2011).
UNIPARC Accession No. UPI00013DD11F (May 6, 2007).
EM_EST Accession No. EG550964—de los Reyes (Oct. 25, 2006).
PCT/US2008/088066—ISR & WO—Mar. 17, 2009.
PCT/US2008/088066—IPRP—Jul. 15, 2010.
GENPEPT Accession No. AAC06592—Deckert (1998).
EP08870439.0—Articla 94(3) Communication—Oct. 29, 2012.

* cited by examiner

*Primary Examiner* — Ganapathirama Raghu
(74) *Attorney, Agent, or Firm* — Brian W. Siddons; Verenium Corporation

(57) ABSTRACT

This invention relates generally to enzymes, polynucleotides encoding the enzymes, the use of such polynucleotides and polypeptides and more specifically to enzymes having isomerase activity, e.g., racemase activity, e.g., amino acid racemase activity, alanine racemase activity, and/or epimerase activity, and/or catalyze the re-arrangement of atoms within a molecule, catalyze the conversion of one isomer into another, catalyze the conversion of an optically active substrate into a raceme, which is optically inactive, catalyze the interconversion of substrate enantiomers, catalyze the stereochemical inversion around the asymmetric carbon atom in a substrate having only one center of asymmetry, catalyze the stereochemical inversion of the configuration around an asymmetric carbon atom in a substrate having more than one asymmetric center, and/or catalyze the racemization of amino acids. Thus, the invention provides enzymes, compositions, methods for production of pharmaceutical compositions, pharmaceutical intermediates, antibiotics, sweeteners, peptide enzymes, peptide hormones, fuel and fuel additive compositions, foods and food additives, beverage and beverage additives, feeds and feed additives, drugs and drug additives, dietary supplements, textiles, wood, paper, pulp, and detergents comprising the polypeptides or polynucleotides in accordance with the invention.

7 Claims, 4 Drawing Sheets

ISOMERASES, NUCLEIC ACIDS ENCODING THEM AND METHODS FOR MAKING AND USING THEM

CROSS REFERENCE TO RELATED APPLICATIONS

This application is a national stage application claiming the benefit of priority under 35 U.S.C. §371 to Patent Cooperation Treaty (PCT) Application No. PCT/US2008/088066 having an international filing date of Dec. 22, 2008, and published as WO 2009/088753, on Jul. 16, 2009, which claims the benefit of priority under 35 U.S.C. §119(e) to U.S. Provisional Application No. 61/018,880 filed Jan. 3, 2008. The contents of the above mentioned patent applications are incorporated by reference herein in their entirety and for all purposes.

REFERENCE TO SEQUENCE LISTING SUBMITTED VIA EFS-WEB

The entire content of the following electronic submission of the sequence listing via the USPTO EFS-WEB server, as authorized and set forth in MPEP 502.05(IX), is incorporated herein by reference in its entirety for all purposes. The sequence listing is identified on the electronically filed .txt file as follows:

| File Name | Date of Creation | Size |
| --- | --- | --- |
| D2440_01N_SequenceListing.txt | Sep. 28, 2010 | 1,298,432 bytes |

FIELD OF THE INVENTION

This invention relates generally to enzymes, polynucleotides encoding the enzymes, the use of such polynucleotides and polypeptides and more specifically to enzymes having isomerase activity, e.g., racemase activity, e.g., amino acid racemase activity, alanine racemase activity, and/or epimerase activity, and/or catalyze the re-arrangement of atoms within a molecule, catalyze the conversion of one isomer into another, catalyze the conversion of an optically active substrate into a raceme, which is optically inactive, catalyze the interconversion of substrate enantiomers, catalyze the stereochemical inversion around the asymmetric carbon atom in a substrate having only one center of asymmetry, catalyze the stereochemical inversion of the configuration around an asymmetric carbon atom in a substrate having more than one asymmetric center, and/or catalyze the racemization of amino acids. Thus, the invention provides enzymes, compositions, methods for production of pharmaceutical (drug) compositions, pharmaceutical (drug) precursors and intermediates, antibiotics, sweeteners, peptide enzymes, peptide hormones, fuel and fuel additive compositions, foods and food additives, beverage and beverage additives, feeds and feed additives, drugs and drug additives, dietary supplements, textiles, wood, paper, pulp, and detergents comprising the polypeptides or polynucleotides in accordance with the invention.

BACKGROUND

Isomerases, e.g., racemases, e.g., amino acid racemases, alanine racemases, and/or epimerases catalyze the re-arrangement of atoms within a molecule, catalyze the conversion of one isomer into another, catalyze the conversion of an optically active substrate into a raceme, which is optically inactive, catalyze the interconversion of substrate enantiomers, catalyze the stereochemical inversion around the asymmetric carbon atom in a substrate having only one center of asymmetry, catalyze the stereochemical inversion of the configuration around an asymmetric carbon atom in a substrate having more than one asymmetric center, and/or catalyze the racemization of amino acids. Isomerases, e.g., racemases, e.g., amino acid racemases, alanine racemases, and/or epimerases are of considerable commercial value, being used in the pharmaceutical industry, in the food, feed and beverage industries, e.g. for the production of sweeteners, in the wood/paper industry and in the fuel industry.

SUMMARY OF THE INVENTION

This invention provides enzymes having isomerase activity, e.g., racemase activity, e.g., amino acid racemase activity, alanine racemase activity, and/or epimerase activity, and/or catalyze the re-arrangement of atoms within a molecule, catalyze the conversion of one isomer into another, catalyze the conversion of an optically active substrate into a raceme, which is optically inactive, catalyze the interconversion of substrate enantiomers, catalyze the stereochemical inversion around the asymmetric carbon atom in a substrate having only one center of asymmetry, catalyze the stereochemical inversion of the configuration around an asymmetric carbon atom in a substrate having more than one asymmetric center, and/or catalyze the racemization of amino acids. The invention further provides enzymes having isomerase activity, e.g., racemase activity, e.g., amino acid racemase activity, alanine racemase activity, and/or epimerase activity and nucleic acids encoding them, vectors and cells comprising them, probes for amplifying and identifying these an isomerase-, e.g., a racemase-, e.g., an amino acid racemase-, an alanine racemase-, and/or an epimerase-isomerase-, e.g., racemase-, e.g., amino acid racemase-, alanine racemase-, and/or epimerase-encoding nucleic acids, and methods for making and using these polypeptides and peptides.

The invention provides enzymes, compositions, methods for production of pharmaceutical (drug) compositions, pharmaceutical (drug) precursors and intermediates, antibiotics, sweeteners, peptide enzymes, peptide hormones, fuel and fuel additive compositions, foods and food additives, beverage and beverage additives, feeds and feed additives, drugs and drug additives, dietary supplements, textiles, wood, paper, pulp, and detergents comprising the polypeptides or polynucleotides in accordance with the invention. These compositions can be formulated in a variety of forms, such as tablets, gels, pills, implants, liquids, sprays, films, micelles, powders, food, feed pellets or as any type of encapsulated form.

In some embodiments, the isomerases, e.g., racemases, e.g., amino acid racemases, alanine racemases, and/or epimerases and/or compositions thereof may be useful in pharmaceutical, industrial, and/or agricultural contexts.

In some embodiments, the isomerases, e.g., racemases, e.g., amino acid racemases, alanine racemases, and/or epimerases and/or compositions thereof may be useful for catalyzing the inversion of stereochemistry in biological molecules. In some embodiments, the isomerases, e.g., racemases, e.g., amino acid racemases, alanine racemases, and/or epimerases and/or compositions thereof may be useful for catalyzing the interconversion of substrate enantiomers. In some embodiments, isomerases, e.g., racemases, e.g., amino acid racemases, and/or alanine racemases catalyze the stereochemical inversion around the asymmetric carbon atom in a substrate having only one center of asymmetry. In some embodiments, isomerases, e.g., epimerases catalyze the stereochemical inversion of the configuration around an asymmetric carbon atom in a substrate having more than one asymmetric center. In some embodiments, isomerases, e.g., racemases, e.g., amino acid racemases, and/or alanine racemases are provided that catalyze the racemization of amino acids. In some embodiments, racemases are provided that catalyze the racemization of a specific amino acid. In some embodiments, isomerases, e.g., racemases, e.g., amino acid racemases, and/or alanine racemases are provided that catalyze the racemization of several amino acids.

In some embodiments, the racemases, e.g., amino acid racemases, alanine racemases, and/or epimerases and/or compositions thereof may be useful in D-amino acid metabolism. D-amino acids are necessary for bacterial growth and for peptidoglycan assembly and cross linking. D-amino acids are also present in the brains of newborn humans. Bacterial serine racemase plays and important role in vancomycin resistance. Some amino acid racemases are PLP dependent; other amino acid racemases are PLP independent. (see, e.g., Yoshimura, T., N. Esaki, 2003, Journal of Bioscience and Bioengineering. 96:103-109). In alternative embodiments, the racemases, e.g., amino acid racemases, alanine racemases, and/or epimerases and/or combinations thereof are components in pharmaceutical (drug) compositions, pharmaceutical (drug) precursors and/or intermediates, e.g. as antibiotics or for treatment of amino acid deficiencies.

In alternative embodiments, the isomerases, e.g., racemases, e.g., amino acid racemases, alanine racemases, and/or epimerases of the invention and/or compositions thereof of may be useful as an antibiotic or in the preparation of antibiotics (see, e.g., Strych, U., M. J. Benedik. 2002, Journal of Bacteriology. 184:4321-4325).

In alternative embodiments, the isomerases, e.g., racemases, e.g., amino acid racemases, alanine racemases, and/or epimerases of the invention and/or compositions thereof of may be useful as in mediation of mammal nervous transmission and maintenance of bacterial cell wall rigidity and strength (see, e.g. Liu, L., K. Iwata, M. Yohda, K. Miki. 2002, FEBS. 528:114-118).

In alternative embodiments, the invention provides enzymes and processes for the bioconversion of any biomass into fuel, e.g. biofuel, e.g., ethanol, propanol, butanol, methanol, and/or biodiesel or biofuels such as synthetic liquids or gases, such as syngas, and the production of other fermentation products, e.g. succinic acid, lactic acid, or acetic acid.

In alternative embodiments, the invention provides polypeptides (and the nucleic acids that encode them) having at least one conservative amino acid substitution and retaining its isomerase activity, e.g., racemase activity, e.g., amino acid racemase activity, alanine racemase activity, and/or epimerase activity; or, wherein the at least one conservative amino acid substitution comprises substituting an amino acid with another amino acid of like characteristics; or, a conservative substitution comprises: replacement of an aliphatic amino acid with another aliphatic amino acid; replacement of a Serine with a Threonine or vice versa; replacement of an acidic residue with another acidic residue; replacement of a residue bearing an amide group with another residue bearing an amide group; exchange of a basic residue with another basic residue; or replacement of an aromatic residue with another aromatic residue;

In alternative embodiments, the invention provides polypeptides (and the nucleic acids that encode them) having an isomerase activity, e.g., a racemase activity, e.g., an amino acid racemase activity, an alanine racemase activity, and/or an epimerase activity but lacking a signal sequence, a prepro domain and/or other domain.

In alternative embodiments, the invention provides polypeptides (and the nucleic acids that encode them) having an isomerase activity, e.g., a racemase activity, e.g., an amino acid racemase activity, an alanine racemase activity, and/or an epimerase activity further comprising a heterologous sequence; and in one aspect, the heterologous sequence comprises, or consists of a sequence encoding: (i) a heterologous signal sequence, a heterologous domain, a heterologous dockerin domain, a heterologous catalytic domain (CD), or a combination thereof; (ii) the sequence of (i), wherein the heterologous signal sequence, domain or catalytic domain (CD) is derived from a heterologous enzyme; or, (iii) a tag, an epitope, a targeting peptide, a cleavable sequence, a detectable moiety or an enzyme; and in one aspect, the heterologous signal sequence targets the encoded protein to a vacuole, the endoplasmic reticulum, a chloroplast or a starch granule.

In alternative embodiments, the invention provides polypeptides (and the nucleic acids that encode them) having an isomerase activity, e.g., a racemase activity, e.g., an amino acid racemase activity, an alanine racemase activity, and/or an epimerase activity, wherein the polypeptides are cofactor dependent or cofactor independent. In one embodiment, a cofactor dependent polypeptide requires the presence of a non-protein component to be functional. In one embodiment, the cofactor comprises a metal ion, a coenzyme, a pyridoxal-phosphate and or a phosphopantetheine.

The invention provides isolated, synthetic or recombinant nucleic acids comprising (a) a nucleic acid (polynucleotide) encoding at least one polypeptide, wherein the nucleic acid comprises a sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more or complete (100%) sequence identity to the nucleic acid (polynucleotide) sequence of SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495 or SEQ ID NO:497; wherein the nucleic acid encodes at least one polypeptide having an isomerase activity, e.g., a racemase activity, e.g., an amino acid racemase activity, an alanine racemase activity, and/or an epimerase activity, or encodes a polypeptide or peptide capable of generating an isomerase specific antibody, e.g., a racemase specific antibody, e.g., an amino acid racemase, an alanine racemase, and/or an epimerase specific antibody (a polypeptide or peptide that acts as an epitope or immunogen), (b) the nucleic acid (polynucleotide) of (a), wherein the sequence identities are determined: (A) by analysis with a sequence comparison algorithm or by a visual inspection, or (B) over a region of at least about 20, 30, 40, 50, 75, 100, 150, 200, 250, 300, 350, 400, 450, 500, 550, 600, 650, 700, 750, 800, 850, 900, 950, 1000, 1050, 1100, 1150 or more residues, or over the full length of a cDNA, transcript (mRNA) or gene;

(c) the nucleic acid (polynucleotide) of (a) or (b), wherein the sequence comparison algorithm is a BLAST version 2.2.2 algorithm where a filtering setting is set to blastall-p blastp-d "nr pataa"-F F, and all other options are set to default;

(d) a nucleic acid (polynucleotide) encoding at least one polypeptide or peptide, wherein the nucleic acid comprises a sequence that hybridizes under stringent conditions to a nucleic acid comprising the sequence of SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495 or SEQ ID NO:497, and the stringent conditions comprise a wash step comprising a wash in 0.2×SSC at a temperature of about 65° C. for about 15 minutes;

(e) the nucleic acid (polynucleotide) of any of (a) to (d) having a length of at least about 20, 25, 30, 50, 75, 100, 125, 150, 175, 200, 225, 300, 350, 400, 450, 500, 550, 600, 650, 700, 750, 800, 850, 900, 950, 1000, 1050, 1100, 1150 or more nucleotide residues, or the full length of a gene or a transcript;

(f) a nucleic acid (polynucleotide) encoding at least one polypeptide having an isomerase activity, e.g., a racemase activity, e.g., an amino acid racemase activity, an alanine racemase activity, and/or an epimerase activity, wherein the polypeptide comprises the sequence of SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496 or SEQ ID NO:498, or enzymatically active fragments thereof;

(g) the nucleic acid (polynucleotide) of any of (a) to (f) and encoding a polypeptide having at least one conservative amino acid substitution and retaining its isomerase activity, e.g., racemase activity, e.g., amino acid racemase activity, alanine racemase activity, and/or epimerase activity, wherein the at least one conservative amino acid substitution comprises substituting an amino acid with another amino acid of like characteristics; or, a conservative substitution comprises: replacement of an aliphatic amino acid with another aliphatic amino acid; replacement of a Serine with a Threonine or vice versa; replacement of an acidic residue with another acidic residue; replacement of a residue bearing an amide group with another residue bearing an amide group; exchange of a basic residue with another basic residue; or replacement of an aromatic residue with another aromatic residue;

(h) the nucleic acid (polynucleotide) of any of (a) to (g) encoding a polypeptide having an isomerase activity, e.g., a racemase activity, e.g., an amino acid racemase activity, an alanine racemase activity, and/or an epimerase activity but lacking a signal sequence, a prepro domain, and/or other domain;

(i) the nucleic acid (polynucleotide) of any of (a) to (h) encoding a polypeptide having an isomerase activity, e.g., a racemase activity, e.g., an amino acid racemase activity, an alanine racemase activity, and/or an epimerase activity further comprising a heterologous sequence;

(j) the nucleic acid (polynucleotide) of (i), wherein the heterologous sequence comprises, or consists of a sequence encoding: (A) a heterologous signal sequence, a heterologous domain, a heterologous dockerin domain, a heterologous catalytic domain (CD), or a combination thereof; (B) the sequence of (i), wherein the heterologous signal sequence, domain or catalytic domain (CD) is derived from a heterologous enzyme; or, (C) a tag, an epitope, a targeting peptide, a cleavable sequence, a detectable moiety or an enzyme;

(k) the nucleic acid (polynucleotide) of (j), wherein the heterologous signal sequence targets the encoded protein to a vacuole, the endoplasmic reticulum, a chloroplast or a starch granule; or (l) a nucleic acid sequence (polynucleotide) fully (completely) complementary to the sequence of any of (a) to (k).

The invention provides isolated, synthetic or recombinant nucleic acids comprising a nucleic acid encoding at least one polypeptide having an isomerase activity, e.g., a racemase activity, e.g., an amino acid racemase activity, an alanine racemase activity, and/or an epimerase activity, wherein the polypeptide has a sequence as set forth in SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496 or SEQ ID NO:498, or enzymatically active fragments thereof, including the sequences described herein and in Tables 1, 2 and 3, and the Sequence Listing (all of these sequences are "exemplary enzymes/polypeptides of the invention"), and enzymatically active subsequences (fragments) thereof and/or immunologically active subsequences thereof (such as epitopes or immunogens) (all "peptides of the invention") and variants thereof (all of these sequences encompassing polypeptide and peptide sequences of the invention) (or, hereinafter referred to as the exemplary polypeptide sequences of the inventions).

The invention provides isolated, synthetic or recombinant nucleic acids comprising sequences completely complementary to all of these nucleic acid sequences of the invention (complementary (non-coding) and coding sequences also hereinafter collectively referred to as nucleic acid sequences of the invention).

In one aspect, the sequence identity is at least about 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% (complete) sequence identity (homology). In one aspect, the sequence identity is over a region of at least about 150, 175, 200, 225, 250, 275, 300, 350, 400, 450, 500, 550, 600, 650, 700, 750, 800, 850, 900, 950, 1000, 1050, 1100, 1150 or more residues, or the full length of a gene or a transcript. For example, the invention provides isolated, synthetic or recombinant nucleic acids comprising a nucleic acid sequence of SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495 or SEQ ID NO:497, e.g., as described in Tables 1, 2 and 3 and in the Sequence Listing (all of these sequences are "exemplary p of the invention"), and enzymatically active subsequences (fragments) thereof.

The invention provides isolated, synthetic or recombinant nucleic acids encoding a polypeptide having an isomerase activity, e.g., a racemase activity, e.g., an amino acid racemase activity, an alanine racemase activity, and/or an epimerase activity, wherein the nucleic acid has at least one sequence modification of an exemplary sequence of the invention, or, any sequence of the invention.

In one aspect (optionally), the isolated, synthetic or recombinant nucleic acids of the invention have an isomerase activity, e.g., a racemase activity, e.g., an amino acid racemase activity, an alanine racemase activity, and/or an epimerase activity, e.g., wherein the activity comprises catalyzing the re-arrangement of atoms within a molecule, catalyzing the conversion of one isomer into another, catalyzing the conversion of an optically active substrate into a raceme, which is optically inactive, catalyzing the interconversion of substrate enantiomers, catalyzing the stereochemical inversion around the asymmetric carbon atom in a substrate having only one center of asymmetry, catalyzing the stereochemical inversion of the configuration around an asymmetric carbon atom in a substrate having more than one asymmetric center, and/or catalyzing the racemization of amino acids.

In one aspect, the isomerase activity, e.g., racemase activity, e.g., amino acid racemase activity, alanine racemase activity, and/or epimerase activity is thermostable, e.g., wherein the polypeptide retains an isomerase activity, e.g., a racemase activity, e.g., an amino acid racemase activity, an alanine racemase activity, and/or an epimerase activity under conditions comprising a temperature range from about −100° C. to about −80° C., about −80° C. to about −40° C., about −40° C. to about −20° C., about −20° C. to about 0° C., about 0° C. to about 5° C., about 5° C. to about 15° C., about 15° C. to about 25° C., about 25° C. to about 37° C., about 37° C. to about 45° C., about 45° C. to about 55° C., about 55° C. to about 70° C., about 70° C. to about 75° C., about 75° C. to about 85° C., about 85° C. to about 90° C., about 90° C. to about 95° C., about 95° C. to about 100° C., about 100° C. to about 105° C., about 105° C. to about 110° C., about 110° C. to about 120° C., or 95° C., 96° C., 97° C., 98° C., 99° C., 100° C., 101° C., 102° C., 103° C., 104° C., 105° C., 106° C., 107° C., 108° C., 109° C., 110° C., 111° C., 112° C., 113° C., 114° C., 115° C. or more. In some embodiments, the thermostable polypeptides according to the invention retains activity, e.g., an isomerase activity, e.g., a racemase activity, e.g., an amino acid racemase activity, an alanine racemase activity, and/or an epimerase activity, at a temperature in the ranges described above, at about pH 3.0, about pH 3.5, about pH 4.0, about pH 4.5, about pH 5.0, about pH 5.5, about pH 6.0, about pH 6.5, about pH 7.0, about pH 7.5, about pH 8.0, about pH 8.5, about pH 9.0, about pH 9.5, about pH 10.0, about pH 10.5, about pH 11.0, about pH 11.5, about pH 12.0 or more.

In one aspect, the isomerase activity, e.g., racemase activity, e.g., amino acid racemase activity, alanine racemase activity, and/or epimerase activity is thermotolerant, e.g., wherein the polypeptide retains an isomerase activity, e.g., a racemase activity, e.g., an amino acid racemase activity, an alanine racemase activity, and/or an epimerase activity after exposure to a temperature in the range from about −100° C. to about −80° C., about −80° C. to about −40° C., about −40° C. to about −20° C., about −20° C. to about 0° C., about 0° C. to about 5° C., about 5° C. to about 15° C., about 15° C. to about 25° C., about 25° C. to about 37° C., about 37° C. to about 45° C., about 45° C. to about 55° C., about 55° C. to about 70° C., about 70° C. to about 75° C., about 75° C. to about 85° C., about 85° C. to about 90° C., about 90° C. to about 95° C., about 95° C. to about 100° C., about 100° C. to about 105° C., about 105° C. to about 110° C., about 110° C. to about 120° C., or 95° C., 96° C., 97° C., 98° C., 99° C., 100° C., 101° C., 102° C., 103° C., 104° C., 105° C., 106° C., 107° C., 108° C., 109° C., 110° C., 111° C., 112° C., 113° C., 114° C., 115° C. or more. The thermotolerant polypeptides according to the invention can retain activity, e.g. an isomerase activity, e.g., a racemase activity, e.g., an amino acid racemase activity, an alanine racemase activity, and/or an epimerase activity, after exposure to a temperature in the range from about −100° C. to about −80° C., about −80° C. to about −40° C., about −40° C. to about −20° C., about −20° C. to about 0° C., about 0° C. to about 5° C., about 5° C. to about 15° C., about 15° C. to about 25° C., about 25° C. to about 37° C., about 37° C. to about 45° C., about 45° C. to about 55° C., about 55° C. to about 70° C., about 70° C. to about 75° C., about 75° C. to about 85° C., about 85° C. to about 90° C., about 90° C. to about 95° C., about 95° C. to about 100° C., about 100° C. to about 105° C., about 105° C. to about 110° C., about 110° C. to about 120° C., or 95° C., 96° C., 97° C., 98° C., 99° C., 100° C., 101° C., 102° C., 103° C., 104° C., 105° C., 106° C., 107° C., 108° C., 109° C., 110° C., 111° C., 112° C., 113° C., 114° C., 115° C. or more. In some embodiments, the thermotolerant polypeptides according to the invention retains activity, e.g. an isomerase activity, e.g., a racemase activity, e.g., an amino acid racemase activity, an alanine racemase activity, and/or an epimerase activity, after exposure to a temperature in the ranges described above, at about pH 3.0, about pH 3.5, about pH 4.0, about pH 4.5, about pH 5.0, about pH 5.5, about pH 6.0, about pH 6.5, about pH 7.0, about pH 7.5, about pH 8.0, about pH 8.5, about pH 9.0, about pH 9.5, about pH 10.0, about pH 10.5, about pH 11.0, about pH 11.5, about pH 12.0 or more.

In one aspect, the isomerase activity, e.g., racemase activity, e.g., amino acid racemase activity, alanine racemase activity, and/or epimerase activity of polypeptides encoded by nucleic acids of the invention retain activity under acidic conditions comprising about pH 6.5, pH 6, pH 5.5, pH 5, pH 4.5, pH 4.0, pH 3.5, pH 3.0 or less (more acidic) pH, or, retain an isomerase activity, e.g., a racemase activity, e.g., an amino acid racemase activity, an alanine racemase activity, and/or an epimerase activity after exposure to acidic conditions comprising about pH 6.5, pH 6, pH 5.5, pH 5, pH 4.5, pH 4.0, pH 3.5, pH 3.0 or less (more acidic) pH; or, retain activity under basic conditions comprising about pH 7, pH 7.5 pH 8.0, pH 8.5, pH 9, pH 9.5, pH 10, pH 10.5, pH 11, pH 11.5, pH 12, pH 12.5 or more (more basic) or, retain an isomerase activity, e.g., a racemase activity, e.g., an amino acid racemase activity, an alanine racemase activity, and/or an epimerase activity after exposure to basic conditions comprising about pH 7, pH 7.5 pH 8.0, pH 8.5, pH 9, pH 9.5, pH 10, pH 10.5, pH 11, pH 11.5, pH 12, pH 12.5 or more (more basic). In one aspect, isomerase activity, e.g., racemase activity, e.g., amino acid racemase activity, alanine racemase activity, and/or epimerase activity of polypeptides encoded by nucleic acids of the invention retain activity at a temperature of at least about 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 7.5 pH 8.0, pH 8.5, pH 9, pH 9.5, pH 10, pH 10.5, pH 11, pH 11.5, pH 12, pH 12.5 or more (more basic).

The invention provides expression cassettes, cloning vehicles, or a vector (e.g., expression vectors) comprising a nucleic acid comprising a sequence of the invention. The cloning vehicle can comprise a viral vector, a plasmid, a phage, a phagemid, a cosmid, a fosmid, a bacteriophage or an artificial chromosome. The viral vector can comprise an adenovirus vector, a retroviral vector or an adeno-associated viral vector. The cloning vehicle can comprise an artificial chromosome comprising a bacterial artificial chromosome (BAC), a bacteriophage P1-derived vector (PAC), a yeast artificial chromosome (YAC), or a mammalian artificial chromosome (MAC).

The invention provides nucleic acid probes for identifying a nucleic acid encoding a polypeptide with an isomerase activity, e.g., a racemase activity, e.g., an amino acid racemase activity, an alanine racemase activity, and/or an epimerase activity, wherein the probe comprises at least about 10, 15, 20, 25, 30, 35, 40, 45, 50, 55, 60, 65, 70, 75, 100, 125, 150, 175, 200, 225, 250, 275, 300 or more consecutive bases of a nucleic acid comprising an exemplary sequence of the invention, or, any sequence of the invention (as defined herein), wherein in one aspect (optionally) the probe comprises an oligonucleotide comprising between at least about 10 to 300, about 25 to 250, about 10 to 50, about 20 to 60, about 30 to 70, about 40 to 80, about 60 to 100, or about 50 to 150 or more consecutive bases.

The invention provides amplification primer pairs for amplifying a nucleic acid encoding a polypeptide having an isomerase activity, e.g., a racemase activity, e.g., an amino acid racemase activity, an alanine racemase activity, and/or an epimerase activity, wherein the primer pair is capable of amplifying a nucleic acid comprising an exemplary sequence of the invention, or, any sequence of the invention (as defined herein), or a subsequence thereof, wherein optionally a member of the amplification primer sequence pair comprises an oligonucleotide comprising at least about 10 to 50 consecutive bases of the sequence, or, about 10, 11, 12, 13, 14, 15, 16, 17, 18, 19, 20, 21, 22, 23, 24, 25, 26, 27, 28, 29, 30, 31, 32, 33, 34, 35 or more consecutive bases of the sequence. The invention provides amplification primer pairs wherein the primer pair comprises a first member having a sequence as set forth by about the first (the 5') 10, 11, 12, 13, 14, 15, 16, 17, 18, 19, 20, 21, 22, 23, 24, 25, 26, 27, 28, 29, 30, 31, 32, 33, 34, 35 or more residues of an exemplary sequence of the invention, or, any sequence of the invention (as defined herein), and a second member having a sequence as set forth by about the first (the 5') 10, 11, 12, 13, 14, 15, 16, 17, 18, 19, 20, 21, 22, 23, 24, 25, 26, 27, 28, 29, 30, 31, 32, 33, 34, 35 or more residues of the complementary strand of the first member.

The invention provides an isomerase-, e.g., a racemase-, e.g., an amino acid racemase-, an alanine racemase-, and/or an epimerase-encoding nucleic acids generated by amplification of a polynucleotide using an amplification primer pair of the invention, wherein optionally the amplification is by polymerase chain reaction (PCR). In one aspect, the nucleic acid is generated by amplification of a gene library, wherein in one aspect (optionally) the gene library is an environmental library. The invention provides isolated, synthetic or recombinant isomerases, e.g., racemases, e.g., amino acid racemases, alanine racemases, and/or epimerases encoded by an isomerase-, e.g., a racemase-, e.g., an amino acid racemase-, an alanine racemase-, and/or an epimerase-encoding nucleic acid generated by amplification of a polynucleotide using an amplification primer pair of the invention. The invention provides methods of amplifying a nucleic acid encoding a polypeptide having an isomerase activity, e.g., a racemase activity, e.g., an amino acid racemase activity, an alanine racemase activity, and/or an epimerase activity, the methods comprising the step of amplification of a template nucleic acid with an amplification primer sequence pair capable of amplifying an exemplary sequence of the invention, or, any sequence of the invention (as defined herein), or a subsequence thereof.

The invention provides expression cassette, a vector or a cloning vehicle comprising a nucleic acid comprising a sequence of the invention, wherein optionally the cloning vehicle comprises a viral vector, a plasmid, a phage, a phagemid, a cosmid, a fosmid, a bacteriophage or an artificial chromosome. The viral vector can comprise an adenovirus vector, a retroviral vector or an adeno-associated viral vector, or, the artificial chromosome comprises a bacterial artificial chromosome (BAC), a bacteriophage P1-derived vector (PAC), a yeast artificial chromosome (YAC), or a mammalian artificial chromosome (MAC).

The invention provides transformed cells comprising a nucleic acid or vector of the invention, or an expression cassette or cloning vehicle of the invention. The transformed cell can be a bacterial cell, a mammalian cell, a fungal cell, a yeast cell, an insect cell or a plant cell.

The invention provides transgenic non-human animals comprising a sequence of the invention. The transgenic non-human animal can be a mouse, a rat, a rabbit, a sheep, a pig, a chicken, a goat, a fish, a dog, or a cow. The invention provides transgenic plants comprising a sequence of the invention, e.g., wherein the plant is a corn plant, a sorghum plant, a potato plant, a tomato plant, a wheat plant, an oilseed plant, a rapeseed plant, a soybean plant, a rice plant, a barley plant, a grass, or a tobacco plant. The invention provides transgenic seeds comprising a sequence of the invention, e.g., wherein the seed is a corn seed, a wheat kernel, an oilseed, a rapeseed, a soybean seed, a palm kernel, a sunflower seed, a sesame seed, a rice, a barley, a peanut or a tobacco plant seed.

The invention provides antisense oligonucleotides comprising a nucleic acid sequence complementary to or capable of hybridizing under stringent conditions to a sequence of the invention (including, e.g., exemplary sequences of the invention), or a subsequence thereof, wherein optionally the antisense oligonucleotide is between about 10 to 50, about 20 to 60, about 30 to 70, about 40 to 80, or about 60 to 100 bases in length, and in one aspect (optionally) the stringent conditions comprise a wash step comprising a wash in 0.2×SSC at a temperature of about 65° C. for about 15 minutes.

The invention provides methods of inhibiting the translation of an isomerase, e.g., a racemase, e.g., an amino acid racemase, an alanine racemase, and/or an epimerase message in a cell comprising administering to the cell or expressing in the cell an antisense oligonucleotide comprising a nucleic acid sequence complementary to or capable of hybridizing under stringent conditions to a sequence of the invention (including, e.g., exemplary sequences of the invention).

The invention provides double-stranded inhibitory RNA (RNAi) molecules comprising a subsequence of a sequence of the invention (including, e.g., exemplary sequences of the invention). The double-stranded inhibitory RNA (RNAi) molecule can be about 10, 11, 12, 13, 14, 15, 16, 17, 18, 19, 20, 21, 22, 23, 24, 25, 26, 27, 28, 29, or 30 or more duplex nucleotides in length. The invention provides methods of inhibiting the expression of an isomerase, e.g., a racemase, e.g., an amino acid racemase, an alanine racemase, and/or an epimerase in a cell comprising administering to the cell or expressing in the cell a double-stranded inhibitory RNA (iRNA), wherein the RNA comprises a subsequence of a sequence of the invention (including, e.g., exemplary sequences of the invention).

The invention provides isolated, synthetic or recombinant polypeptides having an isomerase activity, e.g., a racemase activity, e.g., an amino acid racemase activity, an alanine racemase activity, and/or an epimerase activity, or polypeptides capable of generating an immune response specific for an isomerase, e.g., a racemase, e.g., an amino acid racemase, an alanine racemase, and/or an epimerase (e.g., an epitope); and in alternative aspects peptide and polypeptide of the invention comprise a sequence:

(a) comprising an amino acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or has 100% (complete) sequence identity to SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496 or SEQ ID NO:498, or enzymatically active fragments thereof, wherein the polypeptide or peptide of (i) or (ii) has an isomerase activity, e.g., a racemase activity, e.g., an amino acid racemase activity, an alanine racemase activity, and/or an epimerase activity, or the polypeptide or peptide is capable of generating an isomerase specific antibody, e.g., a racemase specific antibody, e.g., an amino acid racemase, an alanine racemase, and/or an epimerase specific antibody (a polypeptide or peptide that acts as an epitope or immunogen), (b) the polypeptide or peptide of (a), wherein the sequence identities are determined: (A) by analysis with a sequence comparison algorithm or by a visual inspection, or (B) over a region of at least about 20, 25, 30, 35, 40, 45, 50, 55, 60, 75, 100, 150, 200, 250, 300 or more amino acid residues, or over the full length of the polypeptide or peptide or enzyme, and/or enzymatically active subsequences (fragments) thereof, (c) the polypeptide or peptide of (a) of (b), wherein the sequence identities are determined by analysis with a sequence comparison algorithm or by a visual inspection, and optionally the sequence comparison algorithm is a BLAST version 2.2.2 algorithm where a filtering setting is set to blastall-p blastp-d "nr pataa"-F F, and all other options are set to default;

(d) an amino acid sequence encoded by the nucleic acid of claim 1, wherein the polypeptide has (i) an isomerase activity, e.g., a racemase activity, e.g., an amino acid racemase activity, an alanine racemase activity, and/or an epimerase activity, or, (ii) has immunogenic activity in that it is capable of generating an antibody that specifically binds to a polypeptide having a sequence of (a), and/or enzymatically active subsequences (fragments) thereof;

(e) the amino acid sequence of any of (a) to (d), and comprising at least one amino acid residue conservative substitution, and the polypeptide or peptide retains isomerase activity, e.g., racemase activity, e.g., amino acid racemase activity, alanine racemase activity, and/or epimerase activity;

(e) the amino acid sequence of (d), wherein the conservative substitution comprises replacement of an aliphatic amino acid with another aliphatic amino acid; replacement of a serine with a threonine or vice versa; replacement of an acidic residue with another acidic residue; replacement of a residue bearing an amide group with another residue bearing an amide group; exchange of a basic residue with another basic residue; or, replacement of an aromatic residue with another aromatic residue, or a combination thereof, (f) the amino acid sequence of (e), wherein the aliphatic residue comprises Alanine, Valine, Leucine, Isoleucine or a synthetic equivalent thereof; the acidic residue comprises Aspartic acid, Glutamic acid or a synthetic equivalent thereof; the residue comprising an amide group comprises Aspartic acid, Glutamic acid or a synthetic equivalent thereof; the basic residue comprises Lysine, Arginine or a synthetic equivalent thereof; or, the aromatic residue comprises Phenylalanine, Tyrosine or a synthetic equivalent thereof;

(g) the polypeptide of any of (a) to (0 having an isomerase activity, e.g., a racemase activity, e.g., an amino acid racemase activity, an alanine racemase activity, and/or an epimerase activity but lacking a signal sequence, a prepro domain, and/or other domain, (h) the polypeptide of any of (a) to (g) having an isomerase activity, e.g., a racemase activity, e.g., an amino acid racemase activity, an alanine racemase activity, and/or an epimerase activity further comprising a heterologous sequence;

(i) the polypeptide of (h), wherein the heterologous sequence comprises, or consists of: (A) a heterologous signal sequence, a heterologous domain, a heterologous dockerin domain, a heterologous catalytic domain (CD), or a combination thereof; (B) the sequence of (A), wherein the heterologous signal sequence, domain or catalytic domain (CD) is derived from a heterologous enzyme; and/or, (C) a tag, an epitope, a targeting peptide, a cleavable sequence, a detectable moiety or an enzyme;

(j) polypeptide of (i), wherein the heterologous signal sequence targets the encoded protein to a vacuole, the endoplasmic reticulum, a chloroplast or a starch granule; or (k) comprising an amino acid sequence encoded any nucleic acid sequence of this invention.

In one aspect, the isomerase activity, e.g., racemase activity, e.g., amino acid racemase activity, alanine racemase activity, and/or epimerase activity comprises catalyzing the re-arrangement of atoms within a molecule, catalyzing the conversion of one isomer into another, catalyzing the conversion of an optically active substrate into a raceme, which is optically inactive, catalyzing the interconversion of substrate enantiomers, catalyzing the stereochemical inversion around the asymmetric carbon atom in a substrate having only one center of asymmetry, catalyzing the stereochemical inversion of the configuration around an asymmetric carbon atom in a substrate having more than one asymmetric center, and/or catalyzing the racemization of amino acids.

The invention provides isolated, synthetic or recombinant polypeptides comprising a polypeptide of the invention and lacking a signal sequence or a prepro sequence. The invention provides isolated, synthetic or recombinant polypeptides comprising a polypeptide of the invention and having a heterologous signal sequence or a heterologous prepro sequence.

In one aspect, a polypeptide of the invention has isomerase activity, e.g., racemase activity, e.g., amino acid racemase activity, alanine racemase activity, and/or epimerase activity comprising a specific activity at about 37° C. in the range from about 100 to about 1000 units per milligram of protein, from about 500 to about 750 units per milligram of protein, from about 500 to about 1200 units per milligram of protein, or from about 750 to about 1000 units per milligram of protein. In alternative aspects, polypeptides of the invention have isomerase activity, e.g., racemase activity, e.g., amino acid racemase activity, alanine racemase activity, and/or epimerase activity in the range of between about 0.05 to 20 units per gram, or 0.05, 0.10, 0.20, 0.30, 0.40, 0.50, 0.60, 0.70, 0.80, 0.90, 1.0, 1.5, 2.0, 2.5, 3.0, 3.5, 4.0, 4.5, 5.0, 5.5, 6.0, 6.5, 7, 8, 9, 10, 11, 12, 13, 14, 15, 16, 17, 18, 19 or 20 or more units per gram, where a unit equals one μmol of product released per minute per mg of enzyme. In one embodiment, for racemases, one unit of activity equals one μmol of an isomer with inverted configuration (from the starting isomer) produced per minute per mg of enzyme (formed from the respective alpha-amino acid or amine). In an alternative embodiment, for amino acid racemases, one unit of activity equals one umol of R-amino acid produced per minute per mg of enzyme formed from the corresponding S-amino acid. In an alternative embodiment, for amino acid racemases, one unit of activity equals one umol of S-amino acid produced per minute per mg of enzyme formed from the corresponding R-amino acid.

In one aspect, the polypeptides of the invention comprise at least one glycosylation site or further comprises a polysaccharide. The glycosylation can be an N-linked glycosylation, e.g., wherein the polypeptide is glycosylated after being expressed in a P. pastoris or a S. pombe.

The invention provides protein preparation comprising a polypeptide of the invention, wherein the protein preparation comprises a liquid, a slurry, a solid or a gel. The invention provides heterodimers comprising a polypeptide of the invention and a second domain. The second domain can be a polypeptide and the heterodimer is a fusion protein. the second domain can be an epitope or a tag.

The invention provides homodimers or heterodimers comprising a polypeptide of the invention. The invention provides immobilized polypeptides, wherein the polypeptide comprises a sequence of the invention, or a subsequence thereof, or a polypeptide encoded by a nucleic acid of the invention, or a polypeptide comprising a polypeptide of the invention and a second domain, e.g., wherein the polypeptide is immobilized on or inside a cell, a vesicle, a liposome, a film, a membrane, a metal, a resin, a polymer, a ceramic, a glass, a microelectrode, a graphitic particle, a bead, a gel, a plate, an array, a capillary tube, a crystal, a tablet, a pill, a capsule, a powder, an agglomerate, a surface, a porous structure, or materials such as wood chips, brownstock, pulp, paper, and materials deriving therefrom.

The isomerases, e.g., racemases, e.g., amino acid racemases, alanine racemases, and/or epimerases of the invention can be used or formulated alone or as mixture (a "cocktail") of isomerases, e.g., racemases, e.g., amino acid racemases, alanine racemases, and/or epimerases, and other hydrolytic enzymes such as cellulases, mannanases, proteases, lipases, amylases, or redox enzymes such as laccases, peroxidases, catalases, oxidases, or reductases. They can be used formulated in a solid form such as a powder, a lyophilized preparation, a granule, a tablet, a bar, a crystal, a capsule, a pill, a pellet, or in a liquid form such as in an aqueous solution, an aerosol, a gel, a paste, a slurry, an aqueous/oil emulsion, a cream, a capsule, or in a vesicular or micellar suspension. The formulations of the invention can comprise any or a combination of the following ingredients: polyols such as a polyethylene glycol, a polyvinylalcohol, a glycerol, a sugar such as a sucrose, a sorbitol, a trehalose, a glucose, a fructose, a maltose, a mannose, a gelling agent such as a guar gum, a carageenan, an alginate, a dextrans, a cellulosic derivative, a pectin, a salt such as a sodium chloride, a sodium sulfate, an ammonium sulfate, a calcium chloride, a magnesium chloride, a zinc chloride, a zinc sulfate, a salt of a fatty acid and a fatty acid derivative, a metal chelator such as an EDTA, an EGTA, a sodium citrate, an antimicrobial agent such as a fatty acid or a fatty acid derivative, a paraben, a sorbate, a benzoate, an additional modulating compound to block the impact of an enzyme such as a protease, a bulk proteins such as a BSA, a wheat hydrolysate, a borate compound, an amino acid or a peptide, an appropriate pH or temperature modulating compound, an emulsifier such as a non-ionic and/or an ionic detergent, a redox agent such as a cystine/cysteine, a glutathione, an oxidized glutathione, a reduced or an antioxidant compound such as an ascorbic acid, or a dispersant. Cross-linking and protein modification such as pegylation, fatty acid modification, glycosylation can also be used to improve enzyme stability.

The invention provides arrays comprising immobilized polypeptide(s) and/or nucleic acids of the invention, and arrays comprising an immobilized oligonucleotide of the invention. The enzymes, fragments thereof and nucleic acids which encode the enzymes, or probes of the invention, and fragments thereof, can be affixed to a solid support; and these embodiments can be economical and efficient in the use of enzymes and nucleic acids of the invention in industrial, medical, research, pharmaceutical, food and feed and food and feed supplement processing and other applications and processes. For example, a consortium or cocktail of enzymes (or active fragments thereof), which are used in a specific chemical reaction, can be attached to a solid support and dunked into a process vat. The enzymatic reaction can occur. Then, the solid support can be taken out of the vat, along with the enzymes affixed thereto, for repeated use. In one embodiment of the invention, the isolated nucleic acid is affixed to a solid support. In another embodiment of the invention, the solid support is selected from the group of a gel, a resin, a polymer, a ceramic, a glass, a microelectrode and any combination thereof.

For example, solid supports useful in this invention include gels. Some examples of gels include sepharose, gelatin, glutaraldehyde, chitosan-treated glutaraldehyde, albumin-glutaraldehyde, chitosan-Xanthan, toyopearl gel (polymer gel), alginate, alginate-polylysine, carrageenan, agarose, glyoxyl agarose, magnetic agarose, dextran-agarose, poly(Carbamoyl Sulfonate) hydrogel, BSA-PEG hydrogel, phosphorylated polyvinyl alcohol (PVA), monoaminoethyl-N-aminoethyl (MANA), amino, or any combination thereof. Another solid support useful in the present invention are resins or polymers. Some examples of resins or polymers include cellulose, acrylamide, nylon, rayon, polyester, anion-exchange resin, AMBERLITE™ XAD-7, AMBERLITE™ XAD-8, AMBERLITE™ IRA-94, AMBERLITE™ IRC-50, polyvinyl, polyacrylic, polymethacrylate, or any combination thereof. Another type of solid support useful in the present invention is ceramic. Some examples include non-porous ceramic, porous ceramic, $SiO_2$, $Al_2O_3$. Another type of solid support useful in the present invention is glass. Some examples include non-porous glass, porous glass, aminopropyl glass or any combination thereof. Another type of solid support which can be used is a microelectrode. An example is a polyethyleneimine-coated magnetite. Graphitic particles can be used as a solid support. Another example of a solid support is a cell, such as a red blood cell.

There are many methods which would be known to one of skill in the art for immobilizing enzymes or fragments thereof, or nucleic acids, onto a solid support. Some examples of such methods include electrostatic droplet generation, electrochemical means, via adsorption, via covalent binding, via cross-linking, via chemical reaction or process, via encapsulation, via entrapment, via calcium alginate, or via poly (2-hydroxyethyl methacrylate). Like methods are described in *Methods in Enzymology, Immobilized Enzymes and Cells*, Part C. 1987. Academic Press. Edited by S. P. Colowick and N. O. Kaplan. Volume 136; and *Immobilization of Enzymes and Cells*. 1997. Humana Press. Edited by G. F. Bickerstaff. Series: Methods in Biotechnology, Edited by J. M. Walker.

The invention provides isolated, synthetic or recombinant antibodies that specifically binds to a polypeptide of the invention. The antibody can be a monoclonal or a polyclonal antibody, or is a single chained antibody. The invention provides hybridomas comprising an antibody that specifically binds to a polypeptide of the invention.

The invention provides methods of isolating or identifying a polypeptide with an isomerase activity, e.g., a racemase activity, e.g., an amino acid racemase activity, an alanine racemase activity, and/or an epimerase activity comprising the steps of: (a) providing an antibody of the invention; (b) providing a sample comprising polypeptides; and (c) contacting the sample of step (b) with the antibody of step (a) under conditions wherein the antibody can specifically bind to the polypeptide, thereby isolating or identifying a polypeptide having an isomerase activity, e.g., a racemase activity, e.g., an amino acid racemase activity, an alanine racemase activity, and/or an epimerase activity. The invention provides methods of making an anti-isomerase, e.g., anti-racemase, e.g., anti-amino acid racemase, anti-alanine racemase, and/or anti-epimerase antibody comprising administering to a non-human animal a nucleic acid of the invention or a subsequence thereof in an amount sufficient to generate a humoral immune response, thereby making an anti-isomerase, e.g., anti-racemase, e.g., anti-amino acid racemase, anti-alanine racemase, and/or anti-epimerase antibody. The invention provides methods of making an anti-isomerase, e.g., anti-racemase, e.g., anti-amino acid racemase, anti-alanine racemase, and/or anti-epimerase antibody comprising administering to a non-human animal a polypeptide of the invention or a subsequence thereof in an amount sufficient to generate a humoral immune response, thereby making an anti-isomerase, e.g., anti-racemase, e.g., anti-amino acid racemase, anti-alanine racemase, and/or anti-epimerase antibody.

The invention provides methods of producing a recombinant polypeptide comprising the steps of: (a) providing a nucleic acid operably linked to a promoter, wherein the nucleic acid comprises a sequence of the invention; and (b) expressing the nucleic acid of step (a) under conditions that allow expression of the polypeptide, thereby producing a recombinant polypeptide. The method can further comprise transforming a host cell with the nucleic acid of step (a) followed by expressing the nucleic acid of step (a), thereby producing a recombinant polypeptide in a transformed cell.

The invention provides methods for identifying a polypeptide having an isomerase activity, e.g., a racemase activity, e.g., an amino acid racemase activity, an alanine racemase activity, and/or an epimerase activity comprising: (a) providing a polypeptide of the invention; (b) providing an isomerase, e.g., a racemase, e.g., an amino acid racemase, an alanine racemase, and/or an epimerase substrate; and (c) contacting the polypeptide with the substrate of step (b) and detecting a decrease in the amount of substrate or an increase in the amount of a reaction product, wherein a decrease in the amount of the substrate or an increase in the amount of the reaction product detects a polypeptide having an isomerase activity, e.g., a racemase activity, e.g., an amino acid racemase activity, an alanine racemase activity, and/or an epimerase activity.

The invention provides methods for identifying an isomerase, e.g., a racemase, e.g., an amino acid racemase, an alanine racemase, and/or an epimerase substrate comprising: (a) providing a polypeptide of the invention; (b) providing a test substrate; and (c) contacting the polypeptide of step (a) with the test substrate of step (b) and detecting a decrease in the amount of substrate or an increase in the amount of reaction product, wherein a decrease in the amount of the substrate or an increase in the amount of a reaction product identifies the test substrate as an isomerase, e.g., a racemase, e.g., an amino acid racemase, an alanine racemase, and/or an epimerase substrate.

The invention provides methods of determining whether a test compound specifically binds to a polypeptide comprising: (a) expressing a nucleic acid or a vector comprising the nucleic acid under conditions permissive for translation of the nucleic acid to a polypeptide, wherein the nucleic acid has a sequence of the invention; (b) providing a test compound; (c) contacting the polypeptide with the test compound; and (d) determining whether the test compound of step (b) specifically binds to the polypeptide.

The invention provides methods of determining whether a test compound specifically binds to a polypeptide comprising: (a) providing a polypeptide of the invention; (b) providing a test compound; (c) contacting the polypeptide with the test compound; and (d) determining whether the test compound of step (b) specifically binds to the polypeptide.

The invention provides methods for identifying a modulator of an isomerase activity, e.g., a racemase activity, e.g., an amino acid racemase activity, an alanine racemase activity, and/or an epimerase activity comprising: (a) providing a polypeptide of the invention; (b) providing a test compound; (c) contacting the polypeptide of step (a) with the test compound of step (b) and measuring an activity of the isomerase, e.g., racemase, e.g., amino acid racemase, alanine racemase, and/or epimerase, wherein a change in the isomerase activity, e.g., racemase activity, e.g., amino acid racemase activity, alanine racemase activity, and/or epimerase activity measured in the presence of the test compound compared to the activity in the absence of the test compound provides a determination that the test compound modulates the isomerase activity, e.g., racemase activity, e.g., amino acid racemase activity, alanine racemase activity, and/or epimerase activity. The isomerase activity, e.g., racemase activity, e.g., amino acid racemase activity, alanine racemase activity, and/or epimerase activity can be measured by providing an isomerase, e.g., a racemase, e.g., an amino acid racemase, an alanine racemase, and/or an epimerase substrate and detecting a decrease in the amount of the substrate or an increase in the amount of a reaction product, or, an increase in the amount of the substrate or a decrease in the amount of a reaction product. In one aspect, a decrease in the amount of the substrate or an increase in the amount of the reaction product with the test compound as compared to the amount of substrate or reaction product without the test compound identifies the test compound as an activator of an isomerase activity, e.g., a racemase activity, e.g., an amino acid racemase activity, an alanine racemase activity, and/or an epimerase activity. In one aspect, an increase in the amount of the substrate or a decrease in the amount of the reaction product with the test compound as compared to the amount of substrate or reaction product without the test compound identifies the test compound as an inhibitor of an isomerase activity, e.g., a racemase activity, e.g., an amino acid racemase activity, an alanine racemase activity, and/or an epimerase activity.

The invention provides computer systems comprising a processor and a data storage device wherein said data storage device has stored thereon a polypeptide sequence or a nucleic acid sequence, wherein the polypeptide sequence comprises sequence of the invention, a polypeptide encoded by a nucleic acid of the invention. The computer systems can further comprise a sequence comparison algorithm and a data storage device having at least one reference sequence stored thereon. In another aspect, the sequence comparison algorithm comprises a computer program that indicates polymorphisms. In one aspect, the computer system can further comprise an identifier that identifies one or more features in said sequence. The invention provides computer readable media having stored thereon a polypeptide sequence or a nucleic acid sequence of the invention. The invention provides methods for identifying a feature in a sequence comprising the steps of: (a) reading the sequence using a computer program which identifies one or more features in a sequence, wherein the sequence comprises a polypeptide sequence or a nucleic acid sequence of the invention; and (b) identifying one or more features in the sequence with the computer program. The invention provides methods for comparing a first sequence to a second sequence comprising the steps of: (a) reading the first sequence and the second sequence through use of a computer program which compares sequences, wherein the first sequence comprises a polypeptide sequence or a nucleic acid sequence of the invention; and (b) determining differences between the first sequence and the second sequence with the computer program. The step of determining differences between the first sequence and the second sequence can further comprise the step of identifying polymorphisms. In one aspect, the method can further comprise an identifier that identifies one or more features in a sequence. In another aspect, the method can comprise reading the first sequence using a computer program and identifying one or more features in the sequence.

The invention provides methods for isolating or recovering a nucleic acid encoding a polypeptide having an isomerase activity, e.g., a racemase activity, e.g., an amino acid racemase activity, an alanine racemase activity, and/or an epimerase activity from an environmental sample comprising the steps of: (a) providing an amplification primer sequence pair for amplifying a nucleic acid encoding a polypeptide having an isomerase activity, e.g., a racemase activity, e.g., an amino acid racemase activity, an alanine racemase activity, and/or an epimerase activity, wherein the primer pair is capable of amplifying a nucleic acid of the invention; (b) isolating a nucleic acid from the environmental sample or treating the environmental sample such that nucleic acid in the sample is accessible for hybridization to the amplification primer pair; and, (c) combining the nucleic acid of step (b) with the amplification primer pair of step (a) and amplifying nucleic acid from the environmental sample, thereby isolating or recovering a nucleic acid encoding a polypeptide having an isomerase activity, e.g., a racemase activity, e.g., an amino acid racemase activity, an alanine racemase activity, and/or an epimerase activity from an environmental sample. One or each member of the amplification primer sequence pair can comprise an oligonucleotide comprising at least about 10 to 50 consecutive bases of a sequence of the invention. In one aspect, the amplification primer sequence pair is an amplification pair of the invention.

The invention provides methods for isolating or recovering a nucleic acid encoding a polypeptide having an isomerase activity, e.g., a racemase activity, e.g., an amino acid racemase activity, an alanine racemase activity, and/or an epimerase activity from an environmental sample comprising the steps of: (a) providing a polynucleotide probe comprising a nucleic acid of the invention or a subsequence thereof; (b) isolating a nucleic acid from the environmental sample or treating the environmental sample such that nucleic acid in the sample is accessible for hybridization to a polynucleotide probe of step (a); (c) combining the isolated nucleic acid or the treated environmental sample of step (b) with the polynucleotide probe of step (a); and (d) isolating a nucleic acid that specifically hybridizes with the polynucleotide probe of step (a), thereby isolating or recovering a nucleic acid encoding a polypeptide having an isomerase activity, e.g., a racemase activity, e.g., an amino acid racemase activity, an alanine racemase activity, and/or an epimerase activity from an environmental sample. The environmental sample can comprise a water sample, a liquid sample, a soil sample, an air sample or a biological sample. In one aspect, the biological sample can be derived from a bacterial cell, a protozoan cell, an insect cell, a yeast cell, a plant cell, a fungal cell or a mammalian cell.

The invention provides methods of generating a variant of a nucleic acid encoding a polypeptide having an isomerase activity, e.g., a racemase activity, e.g., an amino acid racemase activity, an alanine racemase activity, and/or an epimerase activity comprising the steps of: (a) providing a template nucleic acid comprising a nucleic acid of the invention; and (b) modifying, deleting or adding one or more nucleotides in the template sequence, or a combination thereof, to generate a variant of the template nucleic acid. In one aspect, the method can further comprise expressing the variant nucleic acid to generate a variant isomerase, e.g., racemase, e.g., amino acid racemase, alanine racemase, and/or epimerase polypeptide. The modifications, additions or deletions can be introduced by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (e.g., GeneReassembly, see, e.g., U.S. Pat. No. 6,537,776), Gene Site Saturation Mutagenesis (GSSM), synthetic ligation reassembly (SLR) or a combination thereof. In another aspect, the modifications, additions or deletions are introduced by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

In one aspect, the method can be iteratively repeated until an isomerase, e.g., a racemase, e.g., an amino acid racemase, an alanine racemase, and/or an epimerase having an altered or different activity or an altered or different stability from that of a polypeptide encoded by the template nucleic acid is produced. In one aspect, the variant isomerase, e.g., racemase, e.g., amino acid racemase, alanine racemase, and/or epimerase polypeptide is thermotolerant, and retains some activity after being exposed to an elevated temperature. In another aspect, the variant isomerase, e.g., racemase, e.g., amino acid racemase, alanine racemase, and/or epimerase polypeptide has increased glycosylation as compared to the isomerase, e.g., the racemase, e.g., the amino acid racemase, the alanine racemase, and/or the epimerase encoded by a template nucleic acid. Alternatively, the variant isomerase, e.g., racemase, e.g., amino acid racemase, alanine racemase, and/or epimerase polypeptide has an isomerase activity, e.g., a racemase activity, e.g., an amino acid racemase activity, an alanine racemase activity, and/or an epimerase activity under a high temperature, wherein the isomerase, e.g., the racemase, e.g., the amino acid racemase, the alanine racemase, and/or the epimerase encoded by the template nucleic acid is not active under the high temperature. In one aspect, the method can be iteratively repeated until an isomerase, e.g., a racemase, e.g., an amino acid racemase, an alanine racemase, and/or an epimerase coding sequence having an altered codon usage from that of the template nucleic acid is produced. In another aspect, the method can be iteratively repeated until an isomerase, e.g., a racemase, e.g., an amino acid racemase, an alanine racemase, and/or an epimerase gene having higher or lower level of message expression or stability from that of the template nucleic acid is produced. In another aspect, formulation of the final isomerase, e.g., racemase, e.g., amino acid racemase, alanine racemase, and/or epimerase product enables an increase or modulation of the performance of the isomerase, e.g., the racemase, e.g., the amino acid racemase, the alanine racemase, and/or the epimerase in the product.

The invention provides methods for modifying codons in a nucleic acid encoding a polypeptide having an isomerase activity, e.g., a racemase activity, e.g., an amino acid racemase activity, an alanine racemase activity, and/or an epimerase activity to increase its expression in a host cell, the method comprising: (a) providing a nucleic acid of the invention encoding a polypeptide having an isomerase activity, e.g., a racemase activity, e.g., an amino acid racemase activity, an alanine racemase activity, and/or an epimerase activity; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying codons in a nucleic acid encoding a polypeptide having an isomerase activity, e.g., a racemase activity, e.g., an amino acid racemase activity, an alanine racemase activity, and/or an epimerase activity; the method comprising: (a) providing a nucleic acid of the invention; and, (b) identifying a codon in the nucleic acid of step (a) and replacing it with a different codon encoding the same amino acid as the replaced codon, thereby modifying codons in a nucleic acid encoding an isomerase, e.g., a racemase, e.g., an amino acid racemase, an alanine racemase, and/or an epimerase.

The invention provides methods for modifying codons in a nucleic acid encoding a polypeptide having an isomerase activity, e.g., a racemase activity, e.g., an amino acid racemase activity, an alanine racemase activity, and/or an epimerase activity to increase its expression in a host cell, the method comprising: (a) providing a nucleic acid of the invention encoding an isomerase, e.g., a racemase, e.g., an amino acid racemase, an alanine racemase, and/or an epimerase polypeptide; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying a codon in a nucleic acid encoding a polypeptide having an isomerase activity, e.g., a racemase activity, e.g., an amino acid racemase activity, an alanine racemase activity, and/or an epimerase activity to decrease its expression in a host cell, the method comprising: (a) providing a nucleic acid of the invention; and (b) identifying at least one preferred codon in the nucleic acid of step (a) and replacing it with a non-preferred or less preferred codon encoding the same amino acid as the replaced codon, wherein a preferred codon is a codon over-represented in coding sequences in genes in a host cell and a non-preferred or less preferred codon is a codon under-represented in coding sequences in genes in the host cell, thereby modifying the nucleic acid to decrease its expression in a host cell. In one aspect, the host cell can be a bacterial cell, a fungal cell, an insect cell, a yeast cell, a plant cell or a mammalian cell.

The invention provides methods for producing a library of nucleic acids encoding a plurality of modified isomerase, e.g., racemase, e.g., amino acid racemase, alanine racemase, and/or epimerase active sites or substrate binding sites, wherein the modified active sites or substrate binding sites are derived from a first nucleic acid comprising a sequence encoding a first active site or a first substrate binding site the method comprising: (a) providing a first nucleic acid encoding a first active site or first substrate binding site, wherein the first nucleic acid sequence comprises a sequence that hybridizes under stringent conditions to a sequence of the invention, or a subsequence thereof, and the nucleic acid encodes an isomerase, e.g., a racemase, e.g., an amino acid racemase, an alanine racemase, and/or an epimerase active site or an isomerase, e.g., a racemase, e.g., an amino acid racemase, an alanine racemase, and/or an epimerase substrate binding site; (b) providing a set of mutagenic oligonucleotides that encode naturally-occurring amino acid variants at a plurality of targeted codons in the first nucleic acid; and, (c) using the set of mutagenic oligonucleotides to generate a set of active site-encoding or substrate binding site-encoding variant nucleic acids encoding a range of amino acid variations at each amino acid codon that was mutagenized, thereby producing a library of nucleic acids encoding a plurality of modified isomerase, e.g., racemase, e.g., amino acid racemase, alanine racemase, and/or epimerase active sites or substrate binding sites. In one aspect, the method comprises mutagenizing the first nucleic acid of step (a) by a method comprising an optimized directed evolution system, Gene Site Saturation Mutagenesis (GSSM), or a synthetic ligation reassembly (SLR). In one aspect, the method comprises mutagenizing the first nucleic acid of step (a) or variants by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (GeneReassembly, U.S. Pat. No. 6,537, 776), Gene Site Saturation Mutagenesis (GSSM), synthetic ligation reassembly (SLR) and a combination thereof. In one aspect, the method comprises mutagenizing the first nucleic acid of step (a) or variants by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

The invention provides methods for making a small molecule comprising: (a) providing a plurality of biosynthetic enzymes capable of synthesizing or modifying a small molecule, wherein one of the enzymes comprises an isomerase, e.g., a racemase, e.g., an amino acid racemase, an alanine racemase, and/or an epimerase enzyme encoded by a nucleic acid of the invention; (b) providing a substrate for at least one of the enzymes of step (a); and (c) reacting the substrate of step (b) with the enzymes under conditions that facilitate a plurality of biocatalytic reactions to generate a small molecule by a series of biocatalytic reactions. The invention provides methods for modifying a small molecule comprising: (a) providing an isomerase, e.g., a racemase, e.g., an amino acid racemase, an alanine racemase, and/or an epimerase enzyme, wherein the enzyme comprises a polypeptide of the invention, or, a polypeptide encoded by a nucleic acid of the invention, or a subsequence thereof; (b) providing a small molecule; and (c) reacting the enzyme of step (a) with the small molecule of step (b) under conditions that facilitate an enzymatic reaction catalyzed by the isomerase, e.g., the racemase, e.g., the amino acid racemase, the alanine racemase, and/or the epimerase enzyme, thereby modifying a small molecule by an isomerase, e.g., a racemase, e.g., an amino acid racemase, an alanine racemase, and/or an epimerase enzymatic reaction. In one aspect, the method can comprise a plurality of small molecule substrates for the enzyme of step (a), thereby generating a library of modified small molecules produced by at least one enzymatic reaction catalyzed by the isomerase, e.g., the racemase, e.g., the amino acid racemase, the alanine racemase, and/or the epimerase enzyme. In one aspect, the method can comprise a plurality of additional enzymes under conditions that facilitate a plurality of biocatalytic reactions by the enzymes to form a library of modified small molecules produced by the plurality of enzymatic reactions. In another aspect, the method can further comprise the step of testing the library to determine if a particular modified small molecule that exhibits a desired activity is present within the library. The step of testing the library can further comprise the steps of systematically eliminating all but one of the biocatalytic reactions used to produce a portion of the plurality of the modified small molecules within the library by testing the portion of the modified small molecule for the presence or absence of the particular modified small molecule with a desired activity, and identifying at least one specific biocatalytic reaction that produces the particular modified small molecule of desired activity.

The invention provides methods for determining a functional fragment of an isomerase, e.g., a racemase, e.g., an amino acid racemase, an alanine racemase, and/or an epimerase enzyme comprising the steps of: (a) providing an isomerase, e.g., a racemase, e.g., an amino acid racemase, an alanine racemase, and/or an epimerase enzyme, wherein the enzyme comprises a polypeptide of the invention, or a polypeptide encoded by a nucleic acid of the invention, or a subsequence thereof; and (b) deleting a plurality of amino acid residues from the sequence of step (a) and testing the remaining subsequence for an isomerase activity, e.g., a racemase activity, e.g., an amino acid racemase activity, an alanine racemase activity, and/or an epimerase activity, thereby determining a functional fragment of an isomerase, e.g., a racemase, e.g., an amino acid racemase, an alanine racemase, and/or an epimerase enzyme. In one aspect, the isomerase activity, e.g., racemase activity, e.g., amino acid racemase activity, alanine racemase activity, and/or epimerase activity is measured by providing an isomerase, e.g., a racemase, e.g., an amino acid racemase, an alanine racemase, and/or an epimerase substrate and detecting a decrease in the amount of the substrate or an increase in the amount of a reaction product.

The invention provides methods for whole cell engineering of new or modified phenotypes by using real-time metabolic flux analysis, the method comprising: (a) making a modified cell by modifying the genetic composition of a cell, wherein the genetic composition is modified by addition to the cell of a nucleic acid of the invention; (b) culturing the modified cell to generate a plurality of modified cells; (c) measuring at least one metabolic parameter of the cell by monitoring the cell culture of step (b) in real time; and, (d) analyzing the data of step (c) to determine if the measured parameter differs from a comparable measurement in an unmodified cell under similar conditions, thereby identifying an engineered phenotype in the cell using real-time metabolic flux analysis. In one aspect, the genetic composition of the cell can be modified by a method comprising deletion of a sequence or modification of a sequence in the cell, or, knocking out the expression of a gene. In one aspect, the method can further comprise selecting a cell comprising a newly engineered phenotype. In another aspect, the method can comprise culturing the selected cell, thereby generating a new cell strain comprising a newly engineered phenotype.

The invention provides isolated, synthetic or recombinant signal sequences consisting of, or comprising, a sequence as set forth in residues 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 30, 1 to 31, 1 to 32, 1 to 33, 1 to 34, 1 to 35, 1 to 36, 1 to 37, 1 to 38, 1 to 40, 1 to 41, 1 to 42, 1 to 43 or 1 to 44, of a polypeptide of the invention, including exemplary polypeptide sequences of the invention.

The invention provides chimeric polypeptides comprising at least a first domain comprising a signal peptide (SP) and at least a second domain comprising a heterologous polypeptide or peptide comprising a sequence of the invention, or a subsequence thereof, wherein the heterologous polypeptide or peptide is not naturally associated with the signal peptide (SP). In one aspect, the signal peptide (SP) is not derived from an isomerase, e.g., a racemase, e.g., an amino acid racemase, an alanine racemase, and/or an epimerase. The heterologous polypeptide or peptide can be amino terminal to, carboxy terminal to or on both ends of the signal peptide (SP) or an isomerase, e.g., a racemase, e.g., an amino acid racemase, an alanine racemase, and/or an epimerase catalytic domain (CD). The invention provides isolated, synthetic or recombinant nucleic acids encoding a chimeric polypeptide, wherein the chimeric polypeptide comprises at least a first domain comprising signal peptide (SP) and at least a second domain comprising a heterologous polypeptide or peptide comprising a sequence of the invention, or a subsequence thereof, wherein the heterologous polypeptide or peptide is not naturally associated with the signal peptide (SP).

The invention provides methods of increasing thermotolerance or thermostability of an isomerase, e.g., a racemase, e.g., an amino acid racemase, an alanine racemase, and/or an epimerase polypeptide, the method comprising glycosylating an isomerase, e.g., a racemase, e.g., an amino acid racemase, an alanine racemase, and/or an epimerase polypeptide, wherein the polypeptide comprises at least thirty contiguous amino acids of a polypeptide of the invention; or a polypeptide encoded by a nucleic acid sequence of the invention, thereby increasing the thermotolerance or thermostability of the isomerase, e.g., the racemase, e.g., the amino acid racemase, the alanine racemase, and/or the epimerase polypeptide. In one aspect, the isomerase, e.g., the racemase, e.g., the amino acid racemase, the alanine racemase, and/or the epimerase-specific activity can be thermostable or thermotolerant at a temperature in the range from greater than about 0° C. to about 20° C., about 20° C. to about 37° C., about 37° C. to about 50° C., about 50° C. to about 70° C., about 70° C. to about 75° C., about 75° C. to about 80° C., about 80° C. to about 85° C., about 85° C. to about 90° C., about 90° C. to about 95° C., about 95° C. to about 100° C., about 100° C. to about 110° C., or higher.

The invention provides methods for overexpressing a recombinant isomerase, e.g., racemase, e.g., amino acid racemase, alanine racemase, and/or epimerase polypeptide in a cell comprising expressing a vector comprising a nucleic acid comprising a nucleic acid of the invention or a nucleic acid sequence of the invention, wherein the sequence identities are determined by analysis with a sequence comparison algorithm or by visual inspection, wherein overexpression is effected by use of a high activity promoter, a dicistronic vector or by gene amplification of the vector.

The invention provides methods of making a transgenic plant and seeds comprising: (a) introducing a heterologous nucleic acid sequence into the cell, wherein the heterologous nucleic sequence comprises a nucleic acid sequence of the invention, thereby producing a transformed plant or seed cell; and (b) producing a transgenic plant from the transformed cell or seed. In one aspect, the step (a) can further comprise introducing the heterologous nucleic acid sequence by electroporation or microinjection of plant cell protoplasts. In another aspect, the step (a) can further comprise introducing the heterologous nucleic acid sequence directly to plant tissue by DNA particle bombardment. Alternatively, the step (a) can further comprise introducing the heterologous nucleic acid sequence into the plant cell DNA using an *Agrobacterium tumefaciens* host. In one aspect, the plant cell can be a potato, corn, rice, wheat, tobacco, or barley cell.

The invention provides methods of expressing a heterologous nucleic acid sequence in a plant cell comprising: (a) transforming the plant cell with a heterologous nucleic acid sequence operably linked to a promoter, wherein the heterologous nucleic sequence comprises a nucleic acid of the invention; (b) growing the plant under conditions wherein the heterologous nucleic acids sequence is expressed in the plant cell. The invention provides methods of expressing a heterologous nucleic acid sequence in a plant cell comprising: (a) transforming the plant cell with a heterologous nucleic acid sequence operably linked to a promoter, wherein the heterologous nucleic sequence comprises a sequence of the invention; (b) growing the plant under conditions wherein the heterologous nucleic acids sequence is expressed in the plant cell.

The invention provides detergent compositions comprising a polypeptide of the invention, or a polypeptide encoded by a nucleic acid of the invention, wherein the polypeptide has an isomerase activity, e.g., a racemase activity, e.g., an amino acid racemase activity, an alanine racemase activity, and/or an epimerase activity. The isomerase, e.g., racemase, e.g., amino acid racemase, alanine racemase, and/or epimerase can be nonsurface-active or surface-active. The isomerase, e.g., the racemase, e.g., the amino acid racemase, the alanine racemase, and/or the epimerase can be formulated in a non-aqueous liquid composition, a cast solid, a granular form, a particulate form, a compressed tablet, a gel form, a paste or a slurry form. The invention provides methods for washing an object comprising: (a) providing a composition comprising a polypeptide of the invention having an isomerase activity, e.g., a racemase activity, e.g., an amino acid racemase activity, an alanine racemase activity, and/or an epimerase activity, or a polypeptide encoded by a nucleic acid of the invention; (b) providing an object; and (c) contacting the polypeptide of step (a) and the object of step (b) under conditions wherein the composition can wash the object.

The invention provides textiles or fabrics, including, e.g., threads, comprising a polypeptide of the invention, or a polypeptide encoded by a nucleic acid of the invention. The invention provides methods for treating a textile or fabric (e.g., removing a stain from a composition) comprising: (a) providing a composition comprising a polypeptide of the invention having an isomerase activity, e.g., a racemase activity, e.g., an amino acid racemase activity, an alanine racemase activity, and/or an epimerase activity, or a polypeptide encoded by a nucleic acid of the invention; (b) providing a textile or fabric; and (c) contacting the polypeptide of step (a) and the composition of step (b) under conditions wherein the isomerase, e.g., the racemase, e.g., the amino acid racemase, the alanine racemase, and/or the epimerase can treat the textile or fabric (e.g., remove the stain). The invention provides methods for improving the finish of a fabric comprising: (a) providing a composition comprising a polypeptide of the invention having an isomerase activity, e.g., a racemase activity, e.g., an amino acid racemase activity, an alanine racemase activity, and/or an epimerase activity, or a polypeptide encoded by a nucleic acid of the invention; (b) providing a fabric; and (c) contacting the polypeptide of step (a) and the fabric of step (b) under conditions wherein the polypeptide can treat the fabric thereby improving the finish of the fabric. In one aspect, the fabric is a wool or a silk. In another aspect, the fabric is a cellulosic fiber or a blend of a natural fiber and a synthetic fiber.

The invention provides feeds, foods, feed supplements, food supplements, dietary compositions or dietary aids comprising a polypeptide of the invention, or a polypeptide encoded by a nucleic acid of the invention. The food or the feed can be, e.g., a cereal, a grain, a corn and the like.

The invention provides dough, bread or baked products and/or dough, bread or baked product precursors comprising a polypeptide having an isomerase activity, e.g., a racemase activity, e.g., an amino acid racemase activity, an alanine racemase activity, and/or an epimerase activity, wherein the polypeptide comprises a sequence of the invention, or the polypeptide is encoded by a nucleic acid comprising a sequence of the invention, or an enzymatically active fragment thereof.

The invention provides beverages and beverage precursors comprising a polypeptide, or an enzymatically active fragment thereof, having an isomerase activity, e.g., a racemase activity, e.g., an amino acid racemase activity, an alanine racemase activity, and/or an epimerase activity, wherein the polypeptide comprises a sequence of the invention, or the polypeptide is encoded by a nucleic acid comprising a sequence of the invention. The invention provides methods of beverage production comprising administration of at least one polypeptide having an isomerase activity, e.g., a racemase activity, e.g., an amino acid racemase activity, an alanine racemase activity, and/or an epimerase activity, wherein the polypeptide comprises a sequence of the invention, or the polypeptide is encoded by a nucleic acid comprising a sequence of the invention, or an enzymatically active fragment thereof, to a beverage or a beverage precursor, wherein in one aspect (optionally) the beverage or beverage precursor is a wort or a beer.

The invention provides food, feed or nutritional supplements, e.g. for a human or an animal comprising a polypeptide of the invention, e.g., a polypeptide encoded by the nucleic acid of the invention. In one aspect, the polypeptide in the food or nutritional supplement can be glycosylated. The invention provides edible enzyme delivery matrices comprising a polypeptide of the invention, e.g., a polypeptide encoded by the nucleic acid of the invention. In one aspect, the delivery matrix comprises a pellet. In one aspect, the polypeptide can be glycosylated. In one aspect, the isomerase activity, e.g., racemase activity, e.g., amino acid racemase activity, alanine racemase activity, and/or epimerase activity is thermotolerant. In another aspect, the isomerase activity, e.g., racemase activity, e.g., amino acid racemase activity, alanine racemase activity, and/or epimerase activity is thermostable.

In one aspect, the isomerase, e.g., the racemase, e.g., the amino acid racemase, the alanine racemase, and/or the epimerase enzyme can be prepared by expression of a polynucleotide encoding the isomerase, e.g., the racemase, e.g., the amino acid racemase, the alanine racemase, and/or the epimerase in an organism selected from the group consisting of a bacterium, a yeast, a plant, an insect, a fungus and an animal. The organism can be selected from the group consisting of an *S. pombe, S. cerevisiae, Pichia pastoris, Pseudomonas* sp., *E. coli, Streptomyces* sp., *Bacillus* sp. and *Lactobacillus* sp.

The invention provides edible enzyme delivery matrix comprising a thermostable recombinant isomerase, e.g., racemase, e.g., amino acid racemase, alanine racemase, and/or epimerase enzyme, e.g., a polypeptide of the invention. The invention provides methods for delivering an isomerase, e.g., a racemase, e.g., an amino acid racemase, an alanine racemase, and/or an epimerase supplement to an animal, the method comprising: preparing an edible enzyme delivery matrix in the form of pellets comprising a granulate edible carrier and a thermostable recombinant isomerase, e.g., racemase, e.g., amino acid racemase, alanine racemase, and/or epimerase enzyme, wherein the pellets readily disperse the isomerase, e.g., the racemase, e.g., the amino acid racemase, the alanine racemase, and/or the epimerase enzyme contained therein into aqueous media, and administering the edible enzyme delivery matrix to the animal. The recombinant isomerase, e.g., racemase, e.g., amino acid racemase, alanine racemase, and/or epimerase enzyme can comprise a polypeptide of the invention. The granulate edible carrier can comprise a carrier selected from the group consisting of a grain germ, a grain germ that is spent of oil, a hay, an alfalfa, a timothy, a soy hull, a sunflower seed meal and a wheat midd. The edible carrier can comprise grain germ that is spent of oil. The isomerase, e.g., the racemase, e.g., the amino acid racemase, the alanine racemase, and/or the epimerase enzyme can be glycosylated to provide thermostability at pelletizing conditions. The delivery matrix can be formed by pelletizing a mixture comprising a grain germ and an isomerase, e.g., a racemase, e.g., an amino acid racemase, an alanine racemase, and/or an epimerase. The pelletizing conditions can include application of steam. The pelletizing conditions can comprise application of a temperature in excess of about 80° C. for about 5 minutes and the enzyme retains a specific activity of at least 350 to about 900 units per milligram of enzyme.

The invention provides methods for treating, e.g. improving texture and flavor of a dairy product comprising: (a) providing a polypeptide of the invention having an isomerase activity, e.g., a racemase activity, e.g., an amino acid racemase activity, an alanine racemase activity, and/or an epimerase activity, or an isomerase, e.g., a racemase, e.g., an amino acid racemase, an alanine racemase, and/or an epimerase encoded by a nucleic acid of the invention; (b) providing a dairy product; and (c) contacting the polypeptide of step (a) and the dairy product of step (b) under conditions wherein the isomerase, e.g., the racemase, e.g., the amino acid racemase, the alanine racemase, and/or the epimerase can treat, e.g. improve the texture or flavor of the dairy product. In one aspect, the dairy product comprises a cheese or a yoghurt. The invention provides dairy products comprising an isomerase, e.g., a racemase, e.g., an amino acid racemase, an alanine racemase, and/or an epimerase of the invention, or is encoded by a nucleic acid of the invention.

The invention provides methods for improving the extraction of oil from an oil-rich plant material comprising: (a) providing a polypeptide of the invention having an isomerase activity, e.g., a racemase activity, e.g., an amino acid racemase activity, an alanine racemase activity, and/or an epimerase activity, or an isomerase, e.g., a racemase, e.g., an amino acid racemase, an alanine racemase, and/or an epimerase encoded by a nucleic acid of the invention; (b) providing an oil-rich plant material; and (c) contacting the polypeptide of step (a) and the oil-rich plant material. In one aspect, the oil-rich plant material comprises an oil-rich seed. The oil can be a soybean oil, an olive oil, a rapeseed (canola) oil or a sunflower oil.

The invention provides methods for preparing a fruit or vegetable juice, syrup, puree or extract comprising: (a) providing a polypeptide of the invention having an isomerase activity, e.g., a racemase activity, e.g., an amino acid racemase activity, an alanine racemase activity, and/or an epimerase activity, or an isomerase, e.g., a racemase, e.g., an amino acid racemase, an alanine racemase, and/or an epimerase encoded by a nucleic acid of the invention; (b) providing a composition or a liquid comprising a fruit or vegetable material; and (c) contacting the polypeptide of step (a) and the composition, thereby preparing the fruit or vegetable juice, syrup, puree or extract.

The invention provides methods for treating a wood, a wood product, a paper, a paper product, a pulp, a pulp product, a paper waste or a paper recycling composition comprising: (a) providing a polypeptide of the invention having an isomerase activity, e.g., a racemase activity, e.g., an amino acid racemase activity, an alanine racemase activity, and/or an epimerase activity, or an isomerase, e.g., a racemase, e.g., an amino acid racemase, an alanine racemase, and/or an epimerase encoded by a nucleic acid of the invention; (b) providing a composition comprising a wood, a wood product, a paper, a paper product, a pulp, a pulp product, a paper waste or a paper recycling composition; and (c) contacting the polypeptide of step (a) and the composition, thereby treating the wood, wood product, paper, paper product, pulp, pulp product, paper waste or paper recycling composition. In one aspect of the invention, the treatment comprises reducing or solubilizing lignin (delignification), bleaching or decoloring, and/or deinking.

The invention provides papers or paper products or paper pulp comprising an isomerase, e.g., a racemase, e.g., an amino acid racemase, an alanine racemase, and/or an epimerase of the invention, or a polypeptide encoded by a nucleic acid of the invention. The invention provides methods for treating a paper or a paper or wood pulp comprising: (a) providing a polypeptide of the invention having an isomerase activity, e.g., a racemase activity, e.g., an amino acid racemase activity, an alanine racemase activity, and/or an epimerase activity, or an isomerase, e.g., a racemase, e.g., an amino acid racemase, an alanine racemase, and/or an epimerase encoded by a nucleic acid of the invention; (b) providing a composition comprising a paper or a paper or wood pulp; and (c) contacting the polypeptide of step (a) and the composition of step (b) under conditions wherein the isomerase, e.g., the racemase, e.g., the amino acid racemase, the alanine racemase, and/or the epimerase can treat the paper or paper or wood pulp.

The invention provides methods for bleaching a thread, fabric, yarn, cloth or textile comprising contacting the fabric, yarn, cloth or textile with an isomerase, e.g., a racemase, e.g., an amino acid racemase, an alanine racemase, and/or an epimerase under conditions suitable to produce a whitening of the textile, wherein the isomerase, e.g., the racemase, e.g., the amino acid racemase, the alanine racemase, and/or the epimerase comprises a polypeptide of the invention, or an enzymatically active fragment thereof. The thread, fabric, yarn, cloth or textile can comprise a non-cotton cellulosic thread, fabric, yarn, cloth or textile. The invention provides fabrics, yarns, cloths or textiles comprising a polypeptide having a sequence of the invention, or a polypeptide encoded by a nucleic acid comprising a sequence of the invention, or an enzymatically active fragment thereof, wherein in one aspect (optionally) the fabric, yarn, cloth or textile comprises a non-cotton cellulosic fabric, yarn, cloth or textile.

The invention provides wood, wood chips, wood pulp, wood products, paper pulps, paper products, newspapers or paper waste comprising a polypeptide of the invention, or an enzymatically active fragment thereof. The invention provides thread, fabric, yarn, cloth or textile comprising a polypeptide of the invention, or an enzymatically active fragment thereof.

The invention provides methods for making ethanol comprising contacting an organic material, e.g. a biomass with a polypeptide having an isomerase activity, e.g., a racemase activity, e.g., an amino acid racemase activity, an alanine racemase activity, and/or an epimerase activity, wherein the polypeptide has a sequence of the invention, or the polypeptide is encoded by a nucleic acid comprising a sequence of the invention, or an enzymatically active fragment thereof. The invention provides compositions comprising an ethanol and a polypeptide having an isomerase activity, e.g., a racemase activity, e.g., an amino acid racemase activity, an alanine racemase activity, and/or an epimerase activity, wherein the polypeptide has a sequence of the invention, or the polypeptide is encoded by a nucleic acid comprising a sequence of the invention, or an enzymatically active fragment thereof. The invention provides methods for making ethanol comprising: (a) providing at least one polypeptide having an isomerase activity, e.g., a racemase activity, e.g., an amino acid racemase activity, an alanine racemase activity, and/or an epimerase activity, or an enzymatically active fragment thereof; (b) providing an organic composition; and (c) contacting the composition of step (b) with the polypeptide of step (a).

The invention provides methods of making a pharmaceutical (drug) composition, a pharmaceutical (drug) precursor, or a drug intermediate, comprising using a polypeptide of this invention having an isomerase activity, e.g., a racemase activity, e.g., an amino acid racemase activity, an alanine racemase activity, and/or an epimerase activity.

The invention provides pharmaceutical (drug) compositions and pharmaceutical (drug) precursors and intermediates comprising a polypeptide having an isomerase activity, e.g., a racemase activity, e.g., an amino acid racemase activity, an alanine racemase activity, and/or an epimerase activity, wherein the polypeptide comprises a sequence of the invention, or the polypeptide is encoded by a nucleic acid comprising a sequence of the invention, or an enzymatically active fragment thereof. In one aspect, the pharmaceutical composition acts as a digestive aid, is an antibiotic or is useful for treatment of amino acid deficiencies. In one aspect, the treatment is prophylactic.

In one aspect, the invention provides oral care products comprising a polypeptide of the invention having an isomerase activity, e.g., a racemase activity, e.g., an amino acid racemase activity, an alanine racemase activity, and/or an epimerase activity, or an isomerase, e.g., a racemase, e.g., an amino acid racemase, an alanine racemase, and/or an epimerase encoded by a nucleic acid of the invention. The oral care product can comprise a toothpaste, a dental cream, a gel or a tooth powder, an odontic, a mouth wash, a pre- or post brushing rinse formulation, a chewing gum, a lozenge or a candy. The invention provides contact lens cleaning compositions comprising a polypeptide of the invention having an isomerase activity, e.g., a racemase activity, e.g., an amino acid racemase activity, an alanine racemase activity, and/or an epimerase activity, or an isomerase, e.g., a racemase, e.g., an amino acid racemase, an alanine racemase, and/or an epimerase encoded by a nucleic acid of the invention.

The invention provides chimeric isomerases, e.g., racemases, e.g., amino acid racemases, alanine racemases, and/or epimerases comprising a polypeptide sequence of the invention and at least one heterologous domain, e.g. a binding domain or a dockerin domain. The invention provides methods for designing a chimeric isomerase, e.g., racemase, e.g., amino acid racemase, alanine racemase, and/or epimerase having a new specificity or an enhanced specificity, comprising inserting a heterologous or an additional endogenous domain, e.g. a binding domain or a dockerin domain, into an isomerase, e.g., a racemase, e.g., an amino acid racemase, an alanine racemase, and/or an epimerase, wherein the domain is inserted into an isomerase, e.g., a racemase, e.g., an amino acid racemase, an alanine racemase, and/or an epimerase sequence of the invention.

The invention provides enzyme mixtures, or "cocktails" comprising at least one enzyme of the invention and one or more other enzyme(s), which can be another isomerase, e.g., racemase, e.g., amino acid racemase, alanine racemase, and/or epimerase, or any other enzyme; for example, the "cocktails" of the invention, in addition to at least one enzyme of this invention, can comprise any other enzyme, such as xylanase, cellulases, lipases, esterases, proteases, or endoglycosidases, endo-beta.-1,4-glucanases, beta-glucanases, endo-beta-1,3(4)-glucanases, cutinases, peroxidases, catalases, laccases, amylases, glucoamylases, pectinases, transferases, transaminases, amino transferases, dehydrogenases, oxidoreductases, reductases, oxidases, phenoloxidases, ligninases, pullulanases, arabinanases, hemicellulases, mannanases, xyloglucanases, pectin acetyl esterases, rhamnogalacturonan acetyl esterases, polygalacturonases, rhamnogalacturonases, galactanases, pectin lyases, pectin methylesterases, cellobiohydrolases and/or transglutaminases, to name just a few examples. In alternative embodiments, these enzyme mixtures, or "cocktails" comprising at least one enzyme of the invention can be used in any process or method of the invention, or composition of the invention, e.g., in foods or feeds, food or feed supplements, textiles, papers, processed woods, etc. and methods for making them, and in compositions and methods for treating paper, pulp, wood, paper, pulp or wood waste or by-products, and the like, and in the final products thereof.

The details of one or more embodiments of the invention are set forth in the accompanying drawings and the description below. Other features, objects, and advantages of the invention will be apparent from the description and drawings, and from the claims.

All publications, patents, patent applications, GenBank sequences and ATCC deposits, cited herein are hereby expressly incorporated by reference for all purposes.

BRIEF DESCRIPTION OF THE DRAWINGS

The following drawings are illustrative of aspects of the invention and are not meant to limit the scope of the invention as encompassed by the claims.

The patent or application file contains at least one drawing executed in color. Copies of this patent or patent application publication with color drawing(s) will be provided by the Office upon request and payment of the necessary fee.

Like reference symbols in the various drawings indicate like elements.

DETAILED DESCRIPTION OF THE INVENTION

Figure 1:
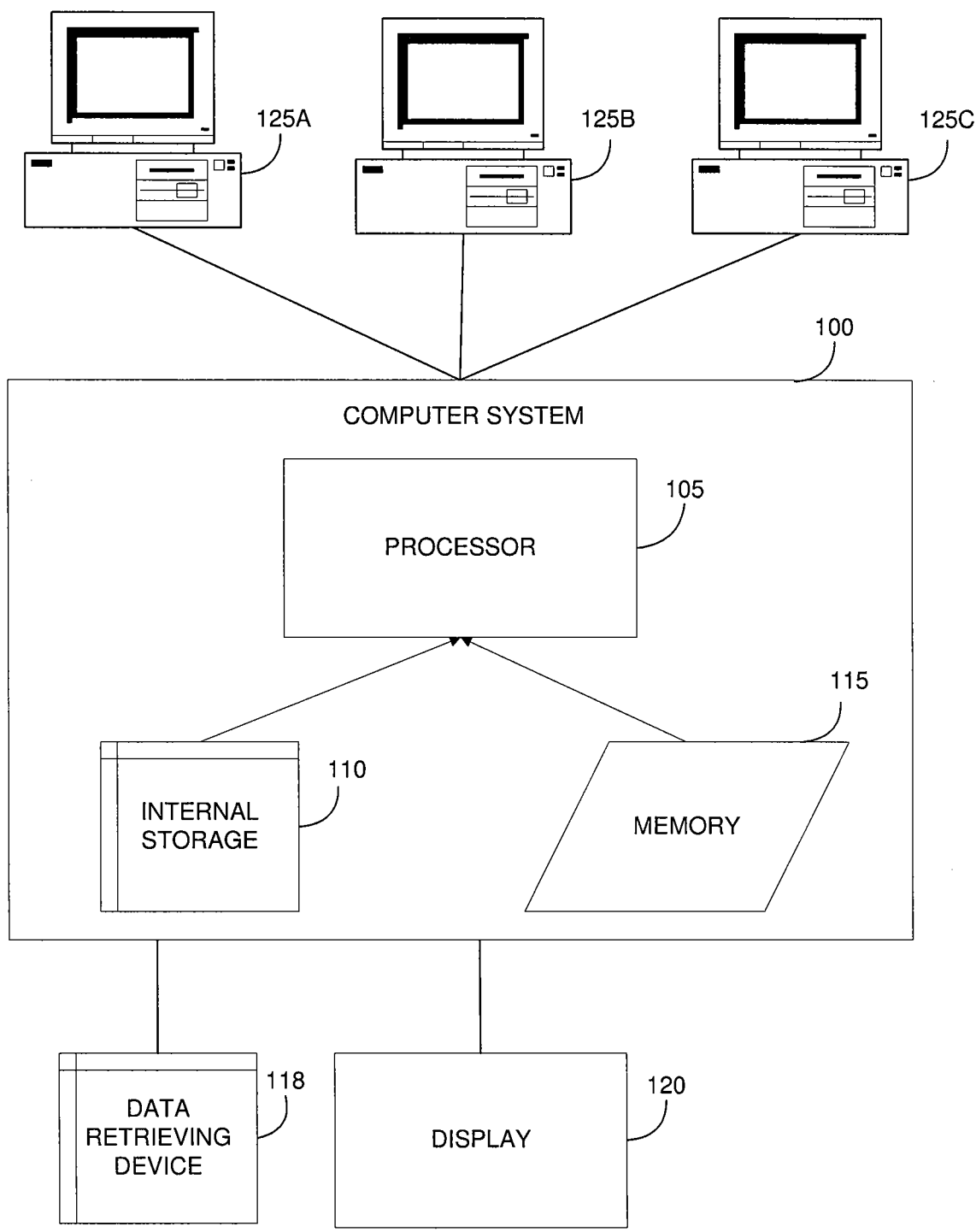
FIG. 1 is a block diagram of a computer system.

The invention provides isomerases, e.g., racemases, e.g., amino acid racemases, alanine racemases, and/or epimerases, and polynucleotides encoding them and methods of making and using them. Isomerases, e.g., racemases, e.g., amino acid racemases, alanine racemases, and/or epimerases, of the polypeptides of the invention encompasses enzymes having isomerase activity, e.g., racemase activity, e.g., amino acid racemase activity, alanine racemase activity, and/or epimerase activity, and/or catalyze the re-arrangement of atoms within a molecule, catalyze the conversion of one isomer into another, catalyze the conversion of an optically active substrate into a raceme, which is optically inactive, catalyze the interconversion of substrate enantiomers, catalyze the stereochemical inversion around the asymmetric carbon atom in a substrate having only one center of asymmetry, catalyze the stereochemical inversion of the configuration around an asymmetric carbon atom in a substrate having more than one asymmetric center, and/or catalyze the racemization of amino acids. The enzymes, e.g., racemases of the invention can be used to make and/or process pharmaceutical (drug) compositions, pharmaceutical (drug) precursors and intermediates, such as molecules comprising unnatural amino acids or antibiotics, sweeteners, peptide enzymes, peptide hormones, fuel and fuel additive compositions, foods and food additives, beverage and beverage additives, feeds and feed additives, drugs and drug additives, dietary supplements, textiles, wood, paper, pulp, detergents and the like.

In one aspect, an enzyme of the invention is thermotolerant and/or tolerant of high and/or low pH conditions. For example, in one aspect, an isomerase, e.g., a racemase, e.g., an amino acid racemase, an alanine racemase, and/or an epimerase of the invention retains activity under conditions comprising a temperature of at least about 80° C., 85° C., 86° C., 87° C., 88° C., 89° C., 90° C., 91° C., 92° C., 93° C., 94° C., 95° C., 96° C., 97° C., 98° C., 99° C., 100° C., 101° C., 102° C., 103° C., 103.5° C., 104° C., 105° C., 107° C., 108° C., 109° C. or 110° C., or more, and a basic pH of at least about pH 11, or more.

The invention provides isolated, synthetic or recombinant nucleic acids comprising a nucleic acid encoding at least one polypeptide having an isomerase activity, e.g., a racemase activity, e.g., an amino acid racemase activity, an alanine racemase activity, and/or an epimerase activity, or other activity as described herein, wherein the nucleic acid comprises a sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity (homology) to SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495 or SEQ ID NO:497, and as described herein and in Tables 1, 2 and 3, and the Sequence Listing (all of these sequences are "exemplary polynucleotides of the invention"), and enzymatically active subsequences (fragments) thereof, over a region of between about 10 to 2500, or more residues, or the full length of a cDNA, transcript (mRNA) or gene. Nucleic acids of the invention includes those encoding a polypeptide of this invention, having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more, or 100% (complete) sequence identity to an exemplary polypeptide of the invention, which includes, e.g., SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496 or SEQ ID NO:498, including the sequences described herein and in Tables 1, 2 and 3, below, and in the Sequence Listing (all of these sequences are "exemplary enzymes/polypeptides of the invention"), and enzymatically active subsequences (fragments) thereof.

Tables 1, 2 and 3, below, are charts describing selected characteristics of exemplary nucleic acids and polypeptides of the invention, including sequence identity comparison of the exemplary sequences to public databases.

Table 1, below, describes the assigned activity (as determined by experimental data, see Examples 1-19, below) of the exemplary polypeptides (encoded by the exemplary polynucleotides) of the invention. Table 1 further indicates whether the polynucleotide (encoding a polypeptide) of the invention is a clone (a genomic sequence isolated from the original source, as described in Table 2) or is a subclone (where the clone is manipulated by, e.g. removal of a native signal sequence, addition of a start Methionine, addition of a tag, etc). Table 1 also indicates the clone and subclone relationship, e.g. which subclone was derived from which clone. For aid in reading Table 1, for example, Columns 1 and 4, rows 1 and 2, indicate that SEQ ID NO:34 (encoded by SEQ ID NO:33) is a clone with the corresponding subclone being SEQ ID NO:464 (encoded by SEQ ID NO:463), denoted as "Clone/subclone pair 1".

Table 2, below, indicates the source from which the exemplary nucleic acids and polypeptides of the invention were first derived. Table 2, below, also indicates the "Signalp Cleavage Site" for the exemplary enzyme's signal sequence (or "signal peptide", or SP), as determined by the paradigm Signalp, as discussed below (see Nielsen (1997), infra); the "Predicted Signal Sequence" is listed from the amino terminal to the carboxy terminal, for example, for the polypeptide SEQ ID NO:42, the signal peptide is "MPFCRTLLAVSLGL-LITGQAPLYA" (amino acids 1-24 of SEQ ID NO:42).

Table 3, below describes selected characteristics of exemplary nucleic acids and polypeptides of the invention, including sequence identity comparison of the exemplary sequences to public databases. To further aid in reading Table 3, for example, the first row, labeled "SEQ ID NO:", the numbers "1, 2" represent the exemplary polypeptide of the invention having a sequence as set forth in SEQ ID NO:2, encoded by, e.g., SEQ ID NO:1. All sequences described in Table 2 (all the exemplary sequences of the invention) have been subject to a BLAST search (as described in detail, below) against two sets of databases. The first database set is available through NCBI (National Center for Biotechnology Information). All results from searches against these databases are found in the columns entitled "NR Description", "NR Accession Code", "NR Evalue" or "NR Organism". "NR" refers to the Non-Redundant nucleotide database maintained by NCBI. This database is a composite of GenBank, GenBank updates, and EMBL updates. The entries in the column "NR Description" refer to the definition line in any given NCBI record, which includes a description of the sequence, such as the source organism, gene name/protein name, or some description of the function of the sequence. The entries in the column "NR Accession Code" refer to the unique identifier given to a sequence record. The entries in the column "NR Evalue" refer to the Expect value (Evalue), which represents the probability that an alignment score as good as the one found between the query sequence (the sequences of the invention) and a database sequence would be found in the same number of comparisons between random sequences as was done in the present BLAST search. The entries in the column "NR Organism" refer to the source organism of the sequence identified as the closest BLAST hit. The second set of databases is collectively known as the GENESEQ™ database, which is available through Thomson Derwent (Philadelphia, Pa.). All results from searches against this database are found in the columns entitled "GENESEQ™ Protein Description", "GENESEQ™ Protein Accession Code", "Evalue", "GENESEQ™ DNA Description", "GENESEQ™ DNA Accession Code" or "Evalue". The information found in these columns is comparable to the information found in the NR columns described above, except that it was derived from BLAST searches against the GENESEQ™ database instead of the NCBI databases. In addition, this table includes the column "Predicted EC No.". An EC number is the number assigned to a type of enzyme according to a scheme of standardized enzyme nomenclature developed by the Enzyme Commission of the Nomenclature Committee of the International Union of Biochemistry and Molecular Biology (IUBMB). The results in the "Predicted EC No." column are determined by a BLAST search against the Kegg (Kyoto Encyclopedia of Genes and Genomes) database. If the top BLAST match has an Evalue equal to or less than e-6, the EC number assigned to the top match is entered into the table. The EC number of the top hit is used as a guide to what the EC number of the sequence of the invention might be. The columns "Query DNA Length" and "Query Protein Length" refer to the number of nucleotides or the number amino acids, respectively, in the sequence of the invention that was searched or queried against either the NCBI or GENESEQ™ databases. The columns "Subject DNA Length" and "Subject Protein Length" refer to the number of nucleotides or the number amino acids, respectively, in the sequence of the top match from the BLAST searches. The results provided in these columns are from the search that returned the lower Evalue, either from the NCBI databases or the Geneseq database. The columns "% ID Protein" and "% ID DNA" refer to the percent sequence identity between the sequence of the invention and the sequence of the top BLAST match. The results provided in these columns are from the search that returned the lower Evalue, either from the NCBI databases or the GENESEQ™ database.

TABLE 1

| Clone/subclone pair | SEQ ID NO: | Activity | Sequence type (Clone or subclone) |
|---|---|---|---|
| 1 | 33, 34 | Racemase | Clone |
| 1 | 463, 464 | Racemase | Subclone |
| 2 | 131, 132 | Racemase | Clone |
| 2 | 457, 458 | Racemase | Subclone |
| 3 | 13, 14 | Racemase | Clone |
| 3 | 387, 388 | Racemase | Subclone |
| 4 | 25, 26 | Racemase | Clone |
| 4 | 389, 390 | Racemase | Subclone |
| 5 | 23, 24 | Racemase | Clone |
| 5 | 391, 392 | Racemase | Subclone |
| 6 | 61, 62 | Racemase | Clone |
| 6 | 411, 412 | Racemase | Subclone (leaderless) |
| 6 | 489, 490 | Racemase | Subclone |
| 7 | 297, 298 | Racemase | Clone |
| 7 | 467, 468 | Racemase | Subclone |
| 8 | 11, 12 | Racemase | Clone |
| 8 | 397, 398 | Racemase | Subclone |
| 9 | 311, 312 | Racemase | Clone |
| 9 | 469, 470 | Racemase | Subclone |
| 10 | 3, 4 | Racemase | Clone |
| 10 | 393, 394 | Racemase | Subclone |
| 11 | 49, 50 | Racemase | Clone |
| 11 | 423, 424 | Racemase | Subclone |
| 12 | 367, 368 | Racemase | Clone |
| 12 | 471, 472 | Racemase | Subclone |
| 13 | 41, 42 | Racemase | Clone |
| 13 | 399, 400 | Racemase | Subclone (leaderless) |

TABLE 1-continued

| Clone/subclone pair | SEQ ID NO: | Activity | Sequence type (Clone or subclone) |
|---|---|---|---|
| 13 | 491, 492 | Racemase | Subclone |
| 14 | 43, 44 | Racemase | Clone |
| 14 | 431, 432 | Racemase | Subclone |
| 15 | 45, 46 | Racemase | Clone |
| 15 | 409, 410 | Racemase | Subclone (leaderless) |
| 15 | 495, 496 | Racemase | Subclone |
| 16 | 47, 48 | Racemase | Clone |
| 16 | 407, 408 | Racemase | Subclone (leaderless) |
| 16 | 493, 494 | Racemase | Subclone |
| 17 | 287, 288 | Racemase | Clone |
| 17 | 453, 454 | Racemase | Subclone |
| 18 | 35, 36 | Racemase | Clone |
| 18 | 385, 386 | Racemase | Subclone |
| 19 | 51, 52 | Racemase | Clone |
| 19 | 401, 402 | Racemase | Subclone (leaderless) |
| 19 | 497, 498 | Racemase | Subclone |
| 20 | 53, 54 | Racemase | Clone |
| 20 | 403, 404 | Racemase | Subclone (leaderless) |
| 20 | 427, 428 | Racemase | Subclone |
| 21 | 55, 56 | Racemase | Clone |
| 21 | 433, 434 | Racemase | Subclone |
| 22 | 107, 108 | Racemase | Clone |
| 22 | 473, 474 | Racemase | Subclone |
| 23 | 57, 58 | Racemase | Clone |
| 23 | 405, 406 | Racemase | Subclone (leaderless) |
| 23 | 429, 430 | Racemase | Subclone |
| 24 | 109, 110 | Racemase | Clone |
| 24 | 415, 416 | Racemase | Subclone |
| 25 | 121, 122 | Racemase | Clone |
| 25 | 425, 426 | Racemase | Subclone |
| 26 | 301, 302 | Racemase | Clone |
| 26 | 477, 478 | Racemase | Subclone |
| 27 | 123, 124 | Racemase | Clone |
| 27 | 439, 440 | Racemase | Subclone |
| 28 | 125, 126 | Racemase | Clone |
| 28 | 461, 462 | Racemase | Subclone |
| 29 | 299, 300 | Racemase | Clone |
| 29 | 475, 476 | Racemase | Subclone |
| 30 | 111, 112 | Racemase | Clone |
| 30 | 417, 418 | Racemase | Subclone |
| 31 | 119, 120 | Racemase | Clone |
| 31 | 459, 460 | Racemase | Subclone |
| 32 | 113, 114 | Racemase | Clone |
| 32 | 435, 436 | Racemase | Subclone |
| 33 | 115, 116 | Racemase | Clone |
| 33 | 419, 420 | Racemase | Subclone |
| 34 | 117, 118 | Racemase | Clone |
| 34 | 421, 422 | Racemase | Subclone |
| 35 | 223, 224 | Racemase | Clone |
| 35 | 441, 442 | Racemase | Subclone |
| 36 | 217, 218 | Racemase | Clone |
| 36 | 443, 444 | Racemase | Subclone |
| 37 | 233, 234 | Racemase | Clone |
| 37 | 445, 446 | Racemase | Subclone |
| 38 | 243, 244 | Racemase | Clone |
| 38 | 447, 448 | Racemase | Subclone |
| 39 | 247, 248 | Racemase | Clone |
| 39 | 449, 450 | Racemase | Subclone |
| 40 | 273, 274 | Racemase | Clone |
| 40 | 451, 452 | Racemase | Subclone |
| 41 | 105, 106 | Racemase | Clone |
| 41 | 465, 466 | Racemase | Subclone |
| 42 | 103, 104 | Racemase | Clone |
| 42 | 437, 438 | Racemase | Subclone |
| 43 | 7, 8 | Racemase | Clone |
| 43 | 413, 414 | Racemase | Subclone |
| 44 | 9, 10 | Racemase | Clone |
| 44 | 395, 396 | Racemase | Subclone |
| 45 | 129, 130 | Racemase | Clone |
| 45 | 455, 456 | Racemase | Subclone |
|  | 379, 380 | Epimerase | Clone |
|  | 381, 382 | Epimerase | Clone |
|  | 369, 370 | Epimerase | Clone |
|  | 375, 376 | Epimerase | Clone |
|  | 383, 384 | Isomerase | Clone |
|  | 373, 374 | Epimerase | Clone |
|  | 371, 372 | Epimerase | Clone |
|  | 377, 378 | Epimerase | Clone |
|  | 17, 18 | Racemase | Clone |
|  | 19, 20 | Racemase | Clone |
|  | 15, 16 | Racemase | Clone |
|  | 29, 30 | Racemase | Clone |
|  | 27, 28 | Racemase | Clone |
|  | 255, 256 | Racemase | Clone |
|  | 321, 322 | Racemase | Clone |
|  | 323, 324 | Racemase | Clone |
|  | 327, 328 | Racemase | Clone |
|  | 307, 308 | Racemase | Clone |
|  | 303, 304 | Racemase | Clone |
|  | 309, 310 | Racemase | Clone |
|  | 305, 306 | Racemase | Clone |
|  | 21, 22 | Racemase | Clone |
|  | 479, 480 | Racemase | Clone |
|  | 313, 314 | Racemase | Clone |
|  | 315, 316 | Racemase | Clone |
|  | 1, 2 | Racemase | Clone |
|  | 85, 86 | Racemase | Clone |
|  | 87, 88 | Racemase | Clone |
|  | 89, 90 | Racemase | Clone |
|  | 91, 92 | Racemase | Clone |
|  | 93, 94 | Racemase | Clone |
|  | 99, 100 | Racemase | Clone |
|  | 77, 78 | Racemase | Clone |
|  | 331, 332 | Racemase | Clone |
|  | 345, 346 | Racemase | Clone |
|  | 347, 348 | Racemase | Clone |
|  | 333, 334 | Racemase | Clone |
|  | 325, 326 | Racemase | Clone |
|  | 319, 320 | Racemase | Clone |
|  | 335, 336 | Racemase | Clone |
|  | 349, 350 | Racemase | Clone |
|  | 339, 340 | Racemase | Clone |
|  | 341, 342 | Racemase | Clone |
|  | 343, 344 | Racemase | Clone |
|  | 355, 356 | Racemase | Clone |
|  | 353, 354 | Racemase | Clone |
|  | 351, 352 | Racemase | Clone |
|  | 317, 318 | Racemase | Clone |
|  | 329, 330 | Racemase | Clone |
|  | 167, 168 | Racemase | Clone |
|  | 213, 214 | Racemase | Clone |
|  | 285, 286 | Racemase | Clone |
|  | 289, 290 | Racemase | Clone |
|  | 37, 38 | Racemase | Clone |
|  | 39, 40 | Racemase | Clone |
|  | 483, 484 | Racemase | Clone |
|  | 485, 486 | Racemase | Clone |
|  | 487, 488 | Racemase | Clone |
|  | 31, 32 | Racemase | Clone |
|  | 101, 102 | Racemase | Clone |
|  | 169, 170 | Racemase | Clone |
|  | 171, 172 | Racemase | Clone |
|  | 59, 60 | Racemase | Clone |
|  | 135, 136 | Racemase | Clone |
|  | 173, 174 | Racemase | Clone |
|  | 137, 138 | Racemase | Clone |
|  | 337, 338 | Racemase | Clone |
|  | 357, 358 | Racemase | Clone |
|  | 359, 360 | Racemase | Clone |
|  | 361, 362 | Racemase | Clone |
|  | 363, 364 | Racemase | Clone |
|  | 365, 366 | Racemase | Clone |
|  | 175, 176 | Racemase | Clone |
|  | 177, 178 | Racemase | Clone |
|  | 179, 180 | Racemase | Clone |
|  | 181, 182 | Racemase | Clone |
|  | 143, 144 | Racemase | Clone |
|  | 187, 188 | Racemase | Clone |
|  | 189, 190 | Racemase | Clone |
|  | 133, 134 | Racemase | Clone |
|  | 145, 146 | Racemase | Clone |
|  | 481, 482 | Racemase | Clone |

TABLE 1-continued

| Clone/subclone pair | SEQ ID NO: | Activity | Sequence type (Clone or subclone) |
|---|---|---|---|
| | 63, 64 | Racemase | Clone |
| | 193, 194 | Racemase | Clone |
| | 153, 154 | Racemase | Clone |
| | 155, 156 | Racemase | Clone |
| | 195, 196 | Racemase | Clone |
| | 157, 158 | Racemase | Clone |
| | 159, 160 | Racemase | Clone |
| | 161, 162 | Racemase | Clone |
| | 163, 164 | Racemase | Clone |
| | 165, 166 | Racemase | Clone |
| | 65, 66 | Racemase | Clone |
| | 147, 148 | Racemase | Clone |
| | 149, 150 | Racemase | Clone |
| | 191, 192 | Racemase | Clone |
| | 151, 152 | Racemase | Clone |
| | 71, 72 | Racemase | Clone |
| | 69, 70 | Racemase | Clone |
| | 73, 74 | Racemase | Clone |
| | 75, 76 | Racemase | Clone |
| | 95, 96 | Racemase | Clone |
| | 97, 98 | Racemase | Clone |
| | 79, 80 | Racemase | Clone |
| | 81, 82 | Racemase | Clone |
| | 83, 84 | Racemase | Clone |
| | 67, 68 | Racemase | Clone |
| | 183, 184 | Racemase | Clone |
| | 139, 140 | Racemase | Clone |
| | 141, 142 | Racemase | Clone |
| | 185, 186 | Racemase | Clone |
| | 197, 198 | Racemase | Clone |
| | 199, 200 | Racemase | Clone |
| | 201, 202 | Racemase | Clone |
| | 203, 204 | Racemase | Clone |
| | 205, 206 | Racemase | Clone |
| | 207, 208 | Racemase | Clone |
| | 209, 210 | Racemase | Clone |
| | 211, 212 | Racemase | Clone |
| | 219, 220 | Racemase | Clone |
| | 221, 222 | Racemase | Clone |
| | 225, 226 | Racemase | Clone |
| | 227, 228 | Racemase | Clone |
| | 229, 230 | Racemase | Clone |
| | 231, 232 | Racemase | Clone |
| | 235, 236 | Racemase | Clone |
| | 237, 238 | Racemase | Clone |
| | 239, 240 | Racemase | Clone |
| | 241, 242 | Racemase | Clone |
| | 293, 294 | Racemase | Clone |
| | 245, 246 | Racemase | Clone |
| | 295, 296 | Racemase | Clone |
| | 249, 250 | Racemase | Clone |
| | 251, 252 | Racemase | Clone |
| | 253, 254 | Racemase | Clone |
| | 257, 258 | Racemase | Clone |
| | 259, 260 | Racemase | Clone |
| | 261, 262 | Racemase | Clone |
| | 263, 264 | Racemase | Clone |
| | 265, 266 | Racemase | Clone |
| | 267, 268 | Racemase | Clone |
| | 269, 270 | Racemase | Clone |
| | 271, 272 | Racemase | Clone |
| | 275, 276 | Racemase | Clone |
| | 277, 278 | Racemase | Clone |
| | 279, 280 | Racemase | Clone |
| | 281, 282 | Racemase | Clone |
| | 283, 284 | Racemase | Clone |
| | 291, 292 | Racemase | Clone |
| | 215, 216 | Racemase | Clone |
| | 5, 6 | Racemase | Clone |
| | 127, 128 | Racemase | Clone |

TABLE 2

| SEQ ID NO: | Source | Signalp Cleavage Site | Predicted Signal Sequence |
|---|---|---|---|
| 1, 2 | *Aquifex aeolicus* | | |
| 3, 4 | *Aquifex aeolicus* | | |
| 5, 6 | Bacteria | | |
| 7, 8 | Bacteria | | |
| 9, 10 | Bacteria | | |
| 11, 12 | Unknown | | |
| 13, 14 | Unknown | | |
| 15, 16 | Unknown | | |
| 17, 18 | Unknown | | |
| 19, 20 | Unknown | | |
| 21, 22 | Unknown | | |
| 23, 24 | Unknown | | |
| 25, 26 | Unknown | | |
| 27, 28 | *Pelagibacter ubique* | | |
| 29, 30 | Unknown | | |
| 31, 32 | Unknown | | |

TABLE 2-continued

| SEQ ID NO: | Source | Signalp Cleavage Site | Predicted Signal Sequence |
|---|---|---|---|
| 33, 34 | Unknown | | |
| 35, 36 | Unknown | | |
| 37, 38 | Unknown | | |
| 39, 40 | Unknown | | |
| 41, 42 | Unknown | Probability: 0.999 AA1: 24 AA2: 25 | MPFCRTLLAVSLGLLITGQAPLYA |
| 43, 44 | Unknown | Probability: 0.999 AA1: 24 AA2: 25 | MPFCRTLLAVSLGLLITGQAPLYA |
| 45, 46 | Unknown | Probability: 1.000 AA1: 24 AA2: 25 | MPFSRTLLAVSLGLLITGQAPLYA |
| 47, 48 | Unknown | Probability: 1.000 AA1: 24 AA2: 25 | MPFSRTLLAVSLGLLITGQAPLYA |
| 49, 50 | Unknown | Probability: 1.000 AA1: 24 AA2: 25 | MPFCRTLLAASLALLITGQAPLYA |
| 51, 52 | Unknown | Probability: 1.000 AA1: 23 AA2: 24 | MPFRRTLLALSLGLVLWQGQVHA |
| 53, 54 | Unknown | Probability: 1.000 AA1: 23 AA2: 24 | MPFCRTLLALSLGLVLWQGQAHA |
| 55, 56 | Unknown | Probability: 1.000 AA1: 23 AA2: 24 | MPFCRTLLALSLGLVLWQGQVHA |
| 57, 58 | Unknown | Probability: 1.000 AA1: 24 AA2: 25 | MPFSRTLLAASLALLITGQAPLYA |
| 59, 60 | Unknown | Probability: 1.000 AA1: 24 AA2: 25 | MPFCRTLLAASLALLITGQAPLYA |
| 61, 62 | Unknown | Probability: 0.999 AA1: 33 AA2: 34 | MFTMIFMKKKFCLLFATIILFITCLCFLLKSVS |
| 63, 64 | Unknown | Probability: 1.000 AA1: 24 AA2: 25 | MPFRRTLLAASLALLITGLAPLYA |
| 65, 66 | Unknown | Probability: 1.000 AA1: 24 AA2: 25 | MPFPRTLLAASLALLITGQAPLYA |
| 67, 68 | Unknown | Probability: 1.000 AA1: 24 AA2: 25 | MPFRRTLLAASLALLVTAQAPLYA |
| 69, 70 | Unknown | Probability: 1.000 AA1: 24 AA2: 25 | MPFCRTLLAASLALLITGQAPLYA |
| 71, 72 | Unknown | Probability: 1.000 AA1: 24 AA2: 25 | MPFRRTLLAASLALLITGQAPLYA |
| 73, 74 | Unknown | Probability: 1.000 AA1: 24 AA2: 25 | MPFCRTLLAASLALLITGQAPLYA |
| 75, 76 | Unknown | Probability: 1.000 AA1: 24 AA2: 25 | MPFPRTLLAASLALLITGQAPLYA |
| 77, 78 | Unknown | Probability: 1.000 AA1: 24 AA2: 25 | MPFRRTLLAASLALLITGQAPLYA |
| 79, 80 | Unknown | Probability: 1.000 AA1: 24 AA2: 25 | MPFCRTLLAASLALLITGQAPLYA |
| 81, 82 | Unknown | Probability: 1.000 AA1: 24 AA2: 25 | MPFCRTLLAASLALLITGQAPLYA |
| 83, 84 | Unknown | Probability: 1.000 AA1: 24 AA2: 25 | MPFCRTLLAASLALLITGQAPLYA |
| 85, 86 | Unknown | Probability: 1.000 AA1: 24 AA2: 25 | MPFSRTLLAASLALLITGQAPLFA |

TABLE 2-continued

| SEQ ID NO: | Source | Signalp Cleavage Site | Predicted Signal Sequence |
|---|---|---|---|
| 87, 88 | Unknown | Probability: 1.000 AA1: 24 AA2: 25 | MPFCRTLLAASLALLITGQAPLYA |
| 89, 90 | Unknown | Probability: 1.000 AA1: 24 AA2: 25 | MPFRRTLLAASLALLITGQAPLFA |
| 91, 92 | Unknown | Probability: 1.000 AA1: 24 AA2: 25 | MPFCRTLLAASLALLITGQAPLYA |
| 93, 94 | Unknown | Probability: 1.000 AA1: 24 AA2: 25 | MPFRRTLLAASLALLITGQAPLYA |
| 95, 96 | Unknown | Probability: 1.000 AA1: 24 AA2: 25 | MPFPRTLLAASLALLITGQAPLYA |
| 97, 98 | Unknown | Probability: 1.000 AA1: 24 AA2: 25 | MPFRRTLLAASLALLITGQAPLYA |
| 99, 100 | Unknown | Probability: 1.000 AA1: 24 AA2: 25 | MPFCRTLLAASLALLITGQAPLYA |
| 101, 102 | Unknown | | |
| 103, 104 | Unknown | Probability: 0.826 AA1: 19 AA2: 20 | MKNNKCIAILGGMGPQASS |
| 105, 106 | Unknown | | |
| 107, 108 | Unknown | Probability: 1.000 AA1: 21 AA2: 22 | MHKKTLLATLILGLLAGQAVA |
| 109, 110 | Unknown | Probability: 1.000 AA1: 21 AA2: 22 | MHKKTLLATLIFGLLAGQAVA |
| 111, 112 | Unknown | Probability: 1.000 AA1: 21 AA2: 22 | MHKKTLLATLILGLLAGQAVA |
| 113, 114 | Unknown | Probability: 1.000 AA1: 21 AA2: 22 | MHKKTLLATLVFGLLAGQAVA |
| 115, 116 | Unknown | Probability: 1.000 AA1: 21 AA2: 22 | MHKKTLLATLVFGLLAGQAVA |
| 117, 118 | Unknown | Probability: 1.000 AA1: 21 AA2: 22 | MHKKTLLATLVFGLLAGQAVA |
| 119, 120 | Unknown | Probability: 1.000 AA1: 21 AA2: 22 | MHKKTLLATLVFGLLAGQAVA |
| 121, 122 | Unknown | | |
| 123, 124 | Unknown | | |
| 125, 126 | Unknown | | |
| 127, 128 | Unknown | | |
| 129, 130 | Unknown | | |
| 131, 132 | Unknown | | |
| 133, 134 | Unknown | Probability: 1.000 AA1: 21 AA2: 22 | MHKKTLLATLILGLLAGQAVA |
| 135, 136 | Unknown | Probability: 1.000 AA1: 21 AA2: 22 | MHKKTLLATLIFGLLAGQAVA |
| 137, 138 | Unknown | Probability: 1.000 AA1: 21 AA2: 22 | MHKKTLLATLIFGLLAGQAVA |
| 139, 140 | Unknown | Probability: 1.000 AA1: 21 AA2: 22 | MHKKTLLATLILGLLAGQAVA |
| 141, 142 | Unknown | Probability: 1.000 AA1: 21 AA2: 22 | MHKKTLLATLIFGLLAGQAVA |

TABLE 2-continued

| SEQ ID NO: | Source | Signalp Cleavage Site | Predicted Signal Sequence |
|---|---|---|---|
| 143, 144 | Unknown | Probability: 1.000 AA1: 21 AA2: 22 | MHKKTLLATLILGLLAGQAVA |
| 145, 146 | Unknown | Probability: 1.000 AA1: 21 AA2: 22 | MHKKTLLATLILGLLAGQAVA |
| 147, 148 | Unknown | Probability: 1.000 AA1: 21 AA2: 22 | MHKKTLLATLILGLLAGQAVA |
| 149, 150 | Unknown | Probability: 1.000 AA1: 21 AA2: 22 | MHKKTLLATLVFGLLAGQAVA |
| 151, 152 | Unknown | Probability: 1.000 AA1: 21 AA2: 22 | MHKKTLLATLVFGLLAGQAVA |
| 153, 154 | Unknown | Probability: 1.000 AA1: 21 AA2: 22 | MHKKTLLATLILGLLAGQAVA |
| 155, 156 | Unknown | Probability: 1.000 AA1: 21 AA2: 22 | MHKKTLLATLILGLLAGQAVA |
| 157, 158 | Unknown | Probability: 1.000 AA1: 21 AA2: 22 | MHKKTLLATLVFGLLAGQAVA |
| 159, 160 | Unknown | Probability: 1.000 AA1: 21 AA2: 22 | MHKKTLLATLVFGLLAGQAVA |
| 161, 162 | Unknown | Probability: 1.000 AA1: 21 AA2: 22 | MHKKTLLATLILGLLAGQAVA |
| 163, 164 | Unknown | | |
| 165, 166 | Unknown | | |
| 167, 168 | Unknown | | |
| 169, 170 | Unknown | Probability: 1.000 AA1: 21 AA2: 22 | MHKKTLLATLILGLLAGQAVA |
| 171, 172 | Unknown | Probability: 1.000 AA1: 21 AA2: 22 | MHKKTLLATLILGLLAGQAVA |
| 173, 174 | Unknown | Probability: 1.000 AA1: 21 AA2: 22 | MHKKTLLATLIFGLLAGQAVA |
| 175, 176 | Unknown | Probability: 1.000 AA1: 21 AA2: 22 | MHKKTLLATLVFGLLAGQAVA |
| 177, 178 | Unknown | Probability: 1.000 AA1: 21 AA2: 22 | MHKKTLLATLILGLLAGQAVA |
| 179, 180 | Unknown | Probability: 1.000 AA1: 21 AA2: 22 | MHKKTLLATLILGLLAGQAVA |
| 181, 182 | Unknown | Probability: 1.000 AA1: 21 AA2: 22 | MHKKTLLATLILGLLAGQAVA |
| 183, 184 | Unknown | Probability: 1.000 AA1: 21 AA2: 22 | MHKKTLLATLILGLLAGQAVA |
| 185, 186 | Unknown | Probability: 1.000 AA1: 21 AA2: 22 | MHKKTLLATLIFGLLAGQAVA |
| 187, 188 | Unknown | Probability: 1.000 AA1: 21 AA2: 22 | MHKKTLLATLILGLLAGQAVA |
| 189, 190 | Unknown | Probability: 1.000 AA1: 21 AA2: 22 | MHKKTLLATLILGLLAGQAVA |
| 191, 192 | Unknown | Probability: 1.000 AA1: 21 AA2: 22 | MHKKTLLATLVFGLLAGQAVA |
| 193, 194 | Unknown | Probability: 1.000 AA1: 21 AA2: 22 | MHKKTLLATLVFGLLAGQAVA |

TABLE 2-continued

| SEQ ID NO: | Source | Signalp Cleavage Site | Predicted Signal Sequence |
|---|---|---|---|
| 195, 196 | Unknown | Probability: 1.000 AA1: 21 AA2: 22 | MHKKTLLATLVFGLLAGQAVA |
| 197, 198 | Unknown | Probability: 1.000 AA1: 21 AA2: 22 | MHKKTLLATLVFGLLAGQAVA |
| 199, 200 | Unknown | Probability: 1.000 AA1: 21 AA2: 22 | MHKKTLLATLIFGLLAGQAVA |
| 201, 202 | Unknown | Probability: 1.000 AA1: 21 AA2: 22 | MHKKTLLATLIFGLLAGQAVA |
| 203, 204 | Unknown | Probability: 1.000 AA1: 21 AA2: 22 | MHKKTLLATLIFGLLAGQAVA |
| 205, 206 | Unknown | Probability: 1.000 AA1: 21 AA2: 22 | MHKKTLLATLIFGLLAGQAVA |
| 207, 208 | Unknown | Probability: 1.000 AA1: 21 AA2: 22 | MHKKTLLATLVFGLLAGQAVA |
| 209, 210 | Unknown | Probability: 1.000 AA1: 21 AA2: 22 | MHKKTLLATLVFGLLAGQAVA |
| 211, 212 | Unknown | Probability: 1.000 AA1: 21 AA2: 22 | MHKKTLLATLVFGLLAGQAVA |
| 213, 214 | Unknown | Probability: 1.000 AA1: 21 AA2: 22 | MHKKTLLATLVFGLLAGQAVA |
| 215, 216 | Unknown | Probability: 1.000 AA1: 21 AA2: 22 | MHKKTLLATLILGLLAGQAVA |
| 217, 218 | Unknown | Probability: 1.000 AA1: 21 AA2: 22 | MHKKTLLATLVFGLLAGQAVA |
| 219, 220 | Unknown | Probability: 1.000 AA1: 21 AA2: 22 | MHKKTLLATLILGLLAGQAVA |
| 221, 222 | Unknown | Probability: 1.000 AA1: 21 AA2: 22 | MHKKTLLATLILGLLAGQAVA |
| 223, 224 | Unknown | Probability: 1.000 AA1: 21 AA2: 22 | MHKKTLLATLILGLLAGQAVA |
| 225, 226 | Unknown | Probability: 1.000 AA1: 21 AA2: 22 | MHKKTLLATLILGLLAGQAVA |
| 227, 228 | Unknown | Probability: 1.000 AA1: 21 AA2: 22 | MHKKTLLATLVFGLLAGQAVA |
| 229, 230 | Unknown | Probability: 1.000 AA1: 21 AA2: 22 | MHKKTLLATLVFGLLAGQAVA |
| 231, 232 | Unknown | Probability: 1.000 AA1: 21 AA2: 22 | MHKKTLLATLILGLLAGQAVA |
| 233, 234 | Unknown | Probability: 1.000 AA1: 21 AA2: 22 | MHKKTLLATLILGLLAGQAVA |
| 235, 236 | Unknown | Probability: 1.000 AA1: 21 AA2: 22 | MHKKTLLATLIFGLLAGQAVA |
| 237, 238 | Unknown | Probability: 1.000 AA1: 21 AA2: 22 | MHKKTLLATLILGLLAGQAVA |
| 239, 240 | Unknown | Probability: 1.000 AA1: 21 AA2: 22 | MHKKTLLATLILGLLAGQAVA |
| 241, 242 | Unknown | Probability: 1.000 AA1: 21 AA2: 22 | MHKKTLLATLILGLLAGQAVA |
| 243, 244 | Unknown | Probability: 1.000 AA1: 21 AA2: 22 | MHKKTLLATLIFGLLAGQAVA |

TABLE 2-continued

| SEQ ID NO: | Source | Signalp Cleavage Site | Predicted Signal Sequence |
|---|---|---|---|
| 245, 246 | Unknown | Probability: 1.000 AA1: 21 AA2: 22 | MHKKTLLATLIFGLLAGQAVA |
| 247, 248 | Unknown | Probability: 1.000 AA1: 21 AA2: 22 | MHKKTLLATLIFGLLAGQAVA |
| 249, 250 | Unknown | Probability: 1.000 AA1: 21 AA2: 22 | MHKKTLLATLIFGLLAGQAVA |
| 251, 252 | Unknown | Probability: 1.000 AA1: 21 AA2: 22 | MHKKTLLATLIFGLLAGQAVA |
| 253, 254 | Unknown | Probability: 1.000 AA1: 21 AA2: 22 | MHKKTLLATLIFGLLAGQAVA |
| 255, 256 | Unknown | | |
| 257, 258 | Unknown | Probability: 1.000 AA1: 21 AA2: 22 | MHKKTLLATLILGLLAGQAVA |
| 259, 260 | Unknown | Probability: 1.000 AA1: 21 AA2: 22 | MHKKTLLATLILGLLAGQAVA |
| 261, 262 | Unknown | Probability: 1.000 AA1: 21 AA2: 22 | MHKKTLLATLILGLLAGQAVA |
| 263, 264 | Unknown | Probability: 1.000 AA1: 21 AA2: 22 | MHKKTLLATLILGLLAGQAVA |
| 265, 266 | Unknown | Probability: 1.000 AA1: 21 AA2: 22 | MHKKTLLATLILGLLAGQAVA |
| 267, 268 | Unknown | Probability: 1.000 AA1: 21 AA2: 22 | MHKKTLLATLILGLLAGQAVA |
| 269, 270 | Unknown | Probability: 1.000 AA1: 21 AA2: 22 | MHKKTLLATLVLGLLAGQAVA |
| 271, 272 | Unknown | Probability: 1.000 AA1: 21 AA2: 22 | MHKKTLLATLVFGLLAGQAVA |
| 273, 274 | Unknown | Probability: 1.000 AA1: 21 AA2: 22 | MHKKTLLATLILGLLAGQAVA |
| 275, 276 | Unknown | Probability: 1.000 AA1: 21 AA2: 22 | MHKKTLLATLILGLLAGQAVA |
| 277, 278 | Unknown | Probability: 1.000 AA1: 21 AA2: 22 | MHKKTLLATLVFGLLAGQAVA |
| 279, 280 | Unknown | Probability: 1.000 AA1: 21 AA2: 22 | MHKKTLLATLVFGLLAGQAVA |
| 281, 282 | Unknown | Probability: 1.000 AA1: 21 AA2: 22 | MHKKTLLATLVFGLLAGQAVA |
| 283, 284 | Unknown | Probability: 1.000 AA1: 21 AA2: 22 | MHKKTLLATLVFGLLAGQAVA |
| 285, 286 | Unknown | Probability: 1.000 AA1: 21 AA2: 22 | MHKKTLLATLILGLLAGQAVA |
| 287, 288 | Unknown | Probability: 1.000 AA1: 21 AA2: 22 | MHKKTLLATLILGLLAGQAVA |
| 289, 290 | Unknown | Probability: 1.000 AA1: 21 AA2: 22 | MHKKTLLATLILGLLAGQAVA |
| 291, 292 | Unknown | Probability: 1.000 AA1: 21 AA2: 22 | MHKKTLLATLVFGLLAGQAVA |
| 293, 294 | Unknown | Probability: 1.000 AA1: 21 AA2: 22 | MHKKTLLATLILGLLAGQAVA |
| 295, 296 | Unknown | Probability: 1.000 AA1: 21 AA2: 22 | MHKKTLLATLIFGLLAGQAVA |

TABLE 2-continued

| SEQ ID NO: | Source | Signalp Cleavage Site | Predicted Signal Sequence |
|---|---|---|---|
| 297, 298 | Unknown | | |
| 299, 300 | Unknown | Probability: 1.000 AA1: 23 AA2: 24 | MPFTRTVLALSLGLVLLQSVHA |
| 301, 302 | Unknown | Probability: 1.000 AA1: 22 AA2: 23 | MKFTPTLLAVALAGCLSTQVQA |
| 303, 304 | Unknown | | |
| 305, 306 | Unknown | | |
| 307, 308 | Unknown | | |
| 309, 310 | Unknown | | |
| 311, 312 | Unknown | | |
| 313, 314 | Unknown | | |
| 315, 316 | Unknown | | |
| 317, 318 | Unknown | | |
| 319, 320 | Unknown | | |
| 321, 322 | Unknown | | |
| 323, 324 | Unknown | | |
| 325, 326 | Unknown | | |
| 327, 328 | Unknown | | |
| 329, 330 | Unknown | | |
| 331, 332 | Unknown | | |
| 333, 334 | Unknown | | |
| 335, 336 | Unknown | | |
| 337, 338 | Unknown | | |
| 339, 340 | Unknown | | |
| 341, 342 | Unknown | | |
| 343, 344 | Unknown | | |
| 345, 346 | Unknown | | |
| 347, 348 | Unknown | | |
| 349, 350 | Unknown | | |
| 351, 352 | Unknown | | |
| 353, 354 | Unknown | | |
| 355, 356 | Unknown | | |
| 357, 358 | Unknown | | |
| 359, 360 | Unknown | | |
| 361, 362 | Unknown | | |
| 363, 364 | Unknown | | |
| 365, 366 | Unknown | | |
| 367, 368 | *Pseudomonas straminea* ATCC 33636 | | |

TABLE 2-continued

| SEQ ID NO: | Source | Signalp Cleavage Site | Predicted Signal Sequence |
|---|---|---|---|
| 369, 370 | Unknown | | |
| 371, 372 | Unknown | | |
| 373, 374 | Unknown | | |
| 375, 376 | Unknown | | |
| 377, 378 | Unknown | | |
| 379, 380 | Unknown | | |
| 381, 382 | Unknown | | |
| 383, 384 | Unknown | | |
| 385, 386 | Unknown | | |
| 387, 388 | Unknown | | |
| 389, 390 | Unknown | | |
| 391, 392 | Unknown | | |
| 393, 394 | Unknown | | |
| 395, 396 | Unknown | | |
| 397, 398 | Unknown | | |
| 399, 400 | Unknown | | |
| 401, 402 | Unknown | | |
| 403, 404 | Unknown | | |
| 405, 406 | Unknown | | |
| 407, 408 | Unknown | | |
| 409, 410 | Unknown | | |
| 411, 412 | Unknown | | |
| 413, 414 | Unknown | | |
| 415, 416 | Unknown | | |
| 417, 418 | Unknown | | |
| 419, 420 | Unknown | | |
| 421, 422 | Unknown | | |
| 423, 424 | Unknown | | |
| 425, 426 | Unknown | | |
| 427, 428 | Unknown | Probability: 1.000 AA1: 23 AA2: 24 | MPFCRTLLALSLGLVLWQGQAHA |
| 429, 430 | Unknown | Probability: 1.000 AA1: 24 AA2: 25 | MPFSRTLLAASLALLITGQAPLYA |
| 431, 432 | Unknown | | |
| 433, 434 | Unknown | | |
| 435, 436 | Unknown | | |
| 437, 438 | Unknown | Probability: 0.826 AA1: 19 AA2: 20 | MKNNKCIAILGGMGPQASS |
| 439, 440 | Unknown | | |
| 441, 442 | Unknown | | |

TABLE 2-continued

| SEQ ID NO: | Source | Signalp Cleavage Site | Predicted Signal Sequence |
|---|---|---|---|
| 443, 444 | Unknown | | |
| 445, 446 | Unknown | | |
| 447, 448 | Unknown | | |
| 449, 450 | Unknown | | |
| 451, 452 | Unknown | | |
| 453, 454 | Unknown | | |
| 455, 456 | Unknown | | |
| 457, 458 | Unknown | Probability: 0.742 AA1: 30 AA2: 31 | MARVVLRWARSAYIRITTGSHALF ADATLA |
| 459, 460 | Unknown | | |
| 461, 462 | Unknown | | |
| 463, 464 | Unknown | | |
| 465, 466 | Unknown | | |
| 467, 468 | Unknown | | |
| 469, 470 | Unknown | | |
| 471, 472 | Unknown | | |
| 473, 474 | Unknown | | |
| 475, 476 | Unknown | | |
| 477, 478 | Unknown | | |
| 479, 480 | Unknown | | |
| 481, 482 | Unknown | | |
| 483, 484 | Unknown | | |
| 485, 486 | Unknown | | |
| 487, 488 | Unknown | | |

TABLE 3

| SEQ ID NO: | NR Description | NR Accession Code | NR Evalue | Organism | Geneseq Protein Description | Geneseq Protein Accession Code | Evalue |
|---|---|---|---|---|---|---|---|
| 1, 2 | hypothetical protein [*Aquifex aeolicus*]. | 15605814 | 1.00E-128 | *Aquifex aeolicus* | Prokaryotical essential gene #34740. | ABU25646 | 3.00E-47 |
| 3, 4 | alanine racemase [*Aquifex aeolicus*]. | 15606873 | 0 | *Aquifex aeolicus* | *Aquifex pyrophilus* heat resistant alanine racemase encoding DNA. | ABB06296 | 1.00E-147 |
| 5, 6 | hypothetical protein SAV6126 [*Streptomyces avermitilis* MA-4680] | 29832668 | 1.00E-101 | *Streptomyces avermitilis* MA-4680 | Prokaryotic essential gene #34740. | ABU19499 | 5.00E-37 |

TABLE 3-continued

| SEQ ID | Description | GI | E-value | Organism | Description 2 | Accession | E-value 2 |
|---|---|---|---|---|---|---|---|
| 7, 8 | hypothetical protein SAV4292 [*Streptomyces avermitilis* MA-4680] | 29830835 | 0 | *Streptomyces avermitilis* MA-4680 | *Propionibacterium acnes* predicted ORF-encoded polypeptide #300. | ABM54358 | 2.00E-53 |
| 9, 10 | alanine racemase [*Streptomyces coelicolor* A3(2)] | 21223124 | 1.00E-166 | *Streptomyces coelicolor* A3(2) | Prokaryotic essential gene #34740. | ABU34223 | 6.00E-90 |
| 11, 12 | alanine racemase [*Rhodopseudomonas palustris* HaA2] | 86748627 | 1.00E-106 | *Rhodopseudomonas palustris* HaA2 | *Pseudomonas aeruginosa* polypeptide #3. | ABO84274 | 4.00E-50 |
| 13, 14 | alanine racemase [*Azoarcus* sp. EbN1] | 56477426 | 1.00E-128 | *Azoarcus* sp. EbN1 | Prokaryotic essential gene #34740. | ABU41398 | 1.00E-110 |
| 15, 16 | Aspartate racemase [*Marinobacter algicola* DG893] | 1.49E+08 | 4.00E-93 | *Marinobacter algicola* DG893 | *Klebsiella pneumoniae* polypeptide seqid 7178. | ABO65503 | 1.00E-71 |
| 17, 18 | glutamate racemase [*Cytophaga hutchinsonii* ATCC 33406] | 1.11E+08 | 1.00E-106 | *Cytophaga hutchinsonii* ATCC 33406 | Prokaryotic essential gene #34740. | ABU25174 | 2.00E-44 |
| 19, 20 | glutamate racemase [*Geobacter sulfurreducens* PCA] | 39998014 | 1.00E-74 | *Geobacter sulfurreducens* PCA | *M. xanthus* protein sequence, seq id 9726. | ABM90755 | 2.00E-67 |
| 21, 22 | Putative decarboxylase [*Bordetella parapertussis* 12822] | 33596748 | 5.00E-40 | *Bordetella parapertussis* 12822 | *Thermococcus kodakaraensis* KOD1 protein sequence SeqID4. | ADN46910 | 5.00E-27 |
| 23, 24 | alanine racemase [*Enterobacter* sp. 638] | 1.46E+08 | 0 | *Enterobacter* sp. 638 | *Enterobacter cloacae* protein amino acid sequence - SEQ ID 5666. | AEH63094 | 0 |
| 25, 26 | alanine racemase [*Enterobacter* sp. 638] | 1.46E+08 | 0 | *Enterobacter* sp. 638 | *Enterobacter cloacae* protein amino acid sequence - SEQ ID 5666. | AEH63094 | 0 |
| 27, 28 | hypothetical protein SAR11_0361 [*Candidatus Pelagibacter ubique* HTCC1062] | 71083067 | 1.00E-121 | *Candidatus Pelagibacter ubique* HTCC1062 | Prokaryotic essential gene #34740. | ABU24290 | 2.00E-31 |
| 29, 30 | putative proline racemase [*Brucella ovis* ATCC 25840] | 1.49E+08 | 1.00E-130 | *Brucella ovis* ATCC 25840 | *Pseudomonas aeruginos* polypeptide #3. | ABO82134 | 1.00E-127 |
| 31, 32 | proline racemase, putative [*Stappia aggregata* IAM | 1.19E+08 | 1.00E-109 | *Stappia aggregata* IAM | *Acinetobacter baumannii* protein | ADA35228 | 1.00E-105 |

TABLE 3-continued

| | | | | | | |
|---|---|---|---|---|---|---|
| | 12614]<br>gi\|118435940\|gb\|EAV42584.1\|<br>proline racemase,<br>putative [*Stappia*<br>*aggregata* IAM<br>12614] | | 12614 | | #19. | |
| 33,<br>34 | alanine racemase<br>[*Mesorhizobium*<br>sp. BNC1] | 1.11E+08 | 1.00E-124 | *Mesorhizobium*<br>sp. BNC1 | Prokaryotic<br>essential<br>gene<br>#34740. | ABU38829 3.00E-46 |
| 35,<br>36 | putative alanine<br>racemase<br>[*Aurantimonas* sp.<br>SI85-9A1]<br>gi\|90338111\|gb\|EAS51762.1\|<br>putative alanine<br>racemase<br>[*Aurantimonas* sp.<br>SI85-9A1] | 90418439 | 6.00E-49 | *Aurantimonas*<br>sp.<br>SI85-9A1 | *Achromobacter*<br>*xylosoxidans*<br>DTA<br>SEQ ID NO<br>6. | AEH19277 5.00E-47 |
| 37,<br>38 | Alanine racemase<br>[*Magnetospirillum*<br>*gryphiswaldense*<br>MSR-1] | 1.45E+08 | 1.00E-38 | *Magnetospirillum*<br>*gryphiswaldense*<br>MSR-1 | *Aquifex*<br>*pyrophilus*<br>heat<br>resistant<br>alanine<br>racemase<br>encoding<br>DNA. | ABB06296 2.00E-20 |
| 39,<br>40 | putative proline<br>racemase<br>[*Burkholderia*<br>*xenovorans*<br>LB400] | 91779222 | 2.00E-36 | *Burkholderia*<br>*xenovorans*<br>LB400 | Prokaryotic<br>essential<br>gene<br>#34740. | ABU21813 5.00E-37 |
| 41,<br>42 | alanine racemase<br>[*Pseudomonas*<br>*putida* F1] | 1.49E+08 | 0 | *Pseudomonas*<br>*putida* F1 | *T. maritima*<br>D-alanine-<br>D-alanine<br>ligase. | AED11803 0 |
| 43,<br>44 | alanine racemase<br>[*Pseudomonas*<br>*putida* F1] | 1.49E+08 | 0 | *Pseudomonas*<br>*putida* F1 | *T. maritima*<br>D-alanine-<br>D-alanine<br>ligase. | AED11803 0 |
| 45,<br>46 | alanine racemase<br>[*Pseudomonas*<br>*putida* F1] | 1.49E+08 | 0 | *Pseudomonas*<br>*putida* F1 | *T. maritima*<br>D-alanine-<br>D-alanine<br>ligase. | AED11803 0 |
| 47,<br>48 | alanine racemase<br>[*Pseudomonas*<br>*putida* F1] | 1.49E+08 | 0 | *Pseudomonas*<br>*putida* F1 | *T. maritima*<br>D-alanine-<br>D-alanine<br>ligase. | AED11803 0 |
| 49,<br>50 | alanine racemase<br>[*Pseudomonas*<br>*putida* F1] | 1.49E+08 | 0 | *Pseudomonas*<br>*putida* F1 | *T. maritima*<br>D-alanine-<br>D-alanine<br>ligase. | AED11803 0 |
| 51,<br>52 | alanine racemase<br>[*Pseudomonas*<br>*putida* GB-1]<br>gi\|126314851\|gb\|EAZ66019.1\|<br>alanine racemase<br>[*Pseudomonas*<br>*putida* GB-1] | 1.26E+08 | 0 | *Pseudomonas*<br>*putida*<br>GB-1 | *T. maritima*<br>D-alanine-<br>D-alanine<br>ligase. | AED11803 1.00E-180 |
| 53,<br>54 | alanine racemase<br>[*Pseudomonas*<br>*putida* GB-1]<br>gi\|126314851\|gb\|EAZ66019.1\|<br>alanine racemase<br>[*Pseudomonas*<br>*putida* GB-1] | 1.26E+08 | 1.00E-180 | *Pseudomonas*<br>*putida*<br>GB-1 | *T. maritima*<br>D-alanine-<br>D-alanine<br>ligase. | AED11803 1.00E-180 |

TABLE 3-continued

| | | | | | | |
|---|---|---|---|---|---|---|
| 55, 56 | alanine racemase [*Pseudomonas putida* GB-1] gi\|126314851\|gb\|EAZ66019.1\| alanine racemase [*Pseudomonas putida* GB-1] | 1.26E+08 | 1.00E-180 | *Pseudomonas putida* GB-1 | *T. maritima* D-alanine-D-alanine ligase. | AED11803 1.00E-179 |
| 57, 58 | alanine racemase [*Pseudomonas putida* F1] | 1.49E+08 | 0 | *Pseudomonas putida* F1 | *T. maritima* D-alanine-D-alanine ligase. | AED11804 0 |
| 59, 60 | alanine racemase [*Pseudomonas putida* F1] | 1.49E+08 | 0 | *Pseudomonas putida* F1 | *T. maritima* D-alanine-D-alanine ligase. | AED11804 0 |
| 61, 62 | alanine racemase [*Fusobacterium nulceatum* subsp. *polymorphum* ATCC 10953] | 1.48E+08 | 7.00E-19 | *Fusobacterium nucleatum* subsp. *polymorphum* ATCC 10953 | *Aquifex pyrophilus* heat resistant alanine racemase encoding DNA. | ABB06296 1.00E-12 |
| 63, 64 | alanine racemase [*Pseudomonas putida* F1] | 1.49E+08 | 0 | *Pseudomonas putida* F1 | *T. maritima* D-alanine-D-alanine ligase. | AED11803 0 |
| 65, 66 | alanine racemase [*Pseudomonas putida* F1] | 1.49E+08 | 0 | *Pseudomonas putida* F1 | *T. maritima* D-alanine-D-alanine ligase. | AED11803 0 |
| 67, 68 | alanine racemase [*Pseudomonas putida* GB-1] gi\|126314851\|gb\|EAZ66019.1\| alanine racemase [*Pseudomonas putida* GB-1] | 1.26E+08 | 0 | *Pseudomonas putida* GB-1 | *T. maritima* D-alanine-D-alanine ligase. | AED11803 0 |
| 69, 70 | alanine racemase [*Pseudomonas putida* GB-1] gi\|126314851\|gb\|EAZ66019.1\| alanine racemase [*Pseudomonas putida* GB-1] | 1.26E+08 | 0 | *Pseudomonas putida* GB-1 | *T. maritima* D-alanine-D-alanine ligase. | AED11803 0 |
| 71, 72 | alanine racemase [*Pseudomonas putida* GB-1] gi\|126314851\|gb\|EAZ66019.1\| alanine racemase [*Pseudomonas putida* GB-1] | 1.26E+08 | 0 | *Pseudomonas putida* GB-1 | *T. maritima* D-alanine-D-alanine ligase. | AED11803 0 |
| 73, 74 | alanine racemase [*Pseudomonas putida* GB-1] gi\|126314851\|gb\|EAZ66019.1\| alanine racemase [*Pseudomonas putida* GB-1] | 1.26E+08 | 0 | *Pseudomonas putida* GB-1 | *T. maritima* D-alanine-D-alanine ligase. | AED11803 0 |
| 75, 76 | alanine racemase [*Pseudomonas putida* GB-1] gi\|126314851\|gb\|EAZ66019.1\| alanine racemase [*Pseudomonas putida* GB-1] | 1.26E+08 | 0 | *Pseudomonas putida* GB-1 | *T. maritima* D-alanine-D-alanine ligase. | AED11803 0 |

TABLE 3-continued

| | | | | | |
|---|---|---|---|---|---|
| 77, 78 | alanine racemase [*Pseudomonas putida* F1] | 1.49E+080 | *Pseudomonas putida* F1 | *T. maritima* D-alanine-D-alanine ligase. | AED11803 0 |
| 79, 80 | alanine racemase [*Pseudomonas putida* F1] | 1.49E+080 | *Pseudomonas putida* F1 | *T. maritima* D-alanine-D-alanine ligase. | AED11804 0 |
| 81, 82 | alanine racemase [*Pseudomonas putida* F1] | 1.49E+080 | *Pseudomonas putida* F1 | *T. maritima* D-alanine-D-alanine ligase. | AED11804 0 |
| 83, 84 | alanine racemase [*Pseudomonas putida* F1] | 1.49E+080 | *Pseudomonas putida* F1 | *T. maritima* D-alanine-D-alanine ligase. | AED11804 0 |
| 85, 86 | alanine racemase [*Pseudomonas putida* F1] | 1.49E+080 | *Pseudomonas putida* F1 | *T. maritima* D-alanine-D-alanine ligase. | AED11803 0 |
| 87, 88 | alanine racemase [*Pseudomonas putida* F1] | 1.49E+080 | *Pseudomonas putida* F1 | *T. maritima* D-alanine-D-alanine ligase. | AED11803 0 |
| 89, 90 | alanine racemase [*Pseudomonas putida* KT2440] | 269904300 | *Pseudomonas putida* KT2440 | *T. maritima* D-alanine-D-alanine ligase. | AED11803 0 |
| 91, 92 | alanine racemase [*Pseudomonas putida* F1] | 1.49E+080 | *Pseudomonas putida* F1 | *T. maritima* D-alanine-D-alanine ligase. | AED11803 0 |
| 93, 94 | alanine racemase [*Pseudomonas putida* F1] | 1.49E+080 | *Pseudomonas putida* F1 | *T. maritima* D-alanine-D-alanine ligase. | AED11804 0 |
| 95, 96 | alanine racemase [*Pseudomonas putida* GB-1] gi|126314851|gb|EAZ66019.1| alanine racemase [*Pseudomonas putida* GB-1] | 1.26E+080 | *Pseudomonas putida* GB-1 | *T. maritima* D-alanine-D-alanine ligase. | AED11803 0 |
| 97, 98 | alanine racemase [*Pseudomonas putida* GB-1] gi|126314851|gb|EAZ66019.1| alanine racemase [*Pseudomonas putida* GB-1] | 1.26E+080 | *Pseudomonas putida* GB-1 | *T. maritima* D-alanine-D-alanine ligase. | AED11803 0 |
| 99, 100 | alanine racemase [*Pseudomonas putida* F1] | 1.49E+080 | *Pseudomonas putida* F1 | *T. maritima* D-alanine-D-alanine ligase. | AED11803 0 |
| 101, 102 | alanine racemase 2, catabolic [*Escherichia coli* O157:H7 EDL933]. | 1580 1412 | 2.00E-58 | *Escherichia coli* O157:H7 EDL933 | Prokaryotic essential gene #34740. | ABU45089 2.00E-58 |
| 103, 104 | aspartate racemase [*Pyrococcus abyssi*]. | 1452 1575 | 8.00E-29 | *Pyrococcus abyssi* | *Thermococcus kodakaraensis* KOD1 protein sequence SeqID4. | ADN46207 2.00E-25 |

TABLE 3-continued

| | | | | | |
|---|---|---|---|---|---|
| 105, 106 | proline racemase [*Microscilla marina* ATCC 23134] gi\|123984081\|gb\|EAY24454.1\| proline racemase [*Microscilla marina* ATCC 23134] | 1.24E+08 1.00E-150 | *Microscilla marina* ATCC 23134 | Bacterial polypeptide #10001. | ADS2299 1.00E-128 |
| 107, 108 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED10581 1.00E-131 |
| 109, 110 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED10581 1.00E-129 |
| 111, 112 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED10581 1.00E-131 |
| 113, 114 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED10581 1.00E-131 |
| 115, 116 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED10581 1.00E-132 |
| 117, 118 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED10581 1.00E-131 |
| 119, 120 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED10581 1.00E-130 |
| 121, 122 | alanine racemase [*Pseudomonas putida* F1] | 1.49E+08 1.00E-136 | *Pseudomonas putida* F1 | *T. maritima* D-alanine-D-alanine ligase. | AED11803 1.00E-137 |
| 123, 124 | alanine racemase [*Aeromonas hydrophila* subsp. *hydrophila* ATCC | 1.18E+08 0 | *Aeromonas hydrophila* subsp. *hydrophila* | *Empedobacter brevis* mature peptide | AED10581 1.00E-127 |

TABLE 3-continued

| | | | | | |
|---|---|---|---|---|---|
| 7966] | | | ATCC 7966 | synthesizing enzyme SEQ ID NO: 3. | |
| 125, 126 | alanine racemase [*Pseudomonas putida* GB-1] gi\|126314851\|gb\|EAZ66019.1\| alanine racemase [*Pseudomonas putida* GB-1] | 1.26E+08 1.00E-155 | *Pseudomonas putida* GB-1 | *Empedobacter brevis* mature peptide synthesizing enzyme SEQ ID NO: 3. | AED1058 1.00E-159 |
| 127, 128 | glutamate racemase [*Bradyrhizobium japonicum* USDA 110] | 27380813 3.00E-26 | *Bradyrhizobium japonicum* USDA 110 | *Photorhabdus luminescens* protein sequence #59. | ABM68637 7.00E-18 |
| 129, 130 | proline racemase, putative [*Stappia aggregata* IAM 12614] gi\|118435940\|gb\|EAV42584.1\| proline racemase, putative [*Stappia aggregata* IAM 12614] | 1.19E+08 1.00E-103 | *Stappia aggregata* IAM 12614 | Prokaryotic essential gene #34740. | ABU21813 1.00E-101 |
| 131, 132 | putative proline racemase [*Myxococcus xanthus* DK 1622] | 1.09E+08 5.00E-75 | *Myxococcus xanthus* DK 1622 | *M. xanthus* protein sequence, seq id 9726. | ABM96637 1.00E-75 |
| 133, 134 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED1058 1.00E-130 |
| 135, 136 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED1058 1.00E-129 |
| 137, 138 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED1058 1.00E-128 |
| 139, 140 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED1058 1.00E-131 |
| 141, 142 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED1058 1.00E-130 |

TABLE 3-continued

| | | | | | |
|---|---|---|---|---|---|
| 143, 144 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 145, 146 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 147, 148 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 149, 150 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 151, 152 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 153, 154 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 155, 156 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-133 |
| 157, 158 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 159, 160 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing | AED105811.00E-131 |

TABLE 3-continued

| | | | | 7966 | enzyme SEQ ID NO: 3. | |
|---|---|---|---|---|---|---|
| 161, 162 | alanine racemase [Aeromonas hydrophila subsp. hydrophila ATCC 7966] | 1.18E+08 | 0 | Aeromonas hydrophila subsp. hydrophila ATCC 7966 | Empedobacter brevis mature peptide synthesizing enzyme SEQ ID NO: 3. | AED10581 1.00E-131 |
| 163, 164 | alanine racemase [Pseudomonas putida F1] | 1.49E+08 | 1.00E-153 | Pseudomonas putida F1 | Empedobacter brevis mature peptide synthesizing enzyme SEQ ID NO: 3. | AED10581 0 |
| 165, 166 | alanine racemase [Pseudomonas putida F1] | 1.49E+08 | 1.00E-153 | Pseudomonas putida F1 | Empedobacter brevis mature peptide synthesizing enzyme SEQ ID NO: 3. | AED10581 0 |
| 167, 168 | proline racemase [Flavobacteriales bacterium HTCC2170] gi\|88708932\|gb\|EAR01166.1\| proline racemase [Flavobacteriales bacterium HTCC2170] | 88712394 | 1.00E-69 | Flavobacteriales bacterium HTCC2170 | Bacterial polypeptide #10001. | ADS22995 2.00E-57 |
| 169, 170 | alanine racemase [Aeromonas hydrophila subsp. hydrophila ATCC 7966] | 1.18E+08 | 0 | Aeromonas hydrophila subsp. hydrophila ATCC 7966 | Empedobacter brevis mature peptide synthesizing enzyme SEQ ID NO: 3. | AED10581 1.00E-131 |
| 171, 172 | alanine racemase [Aeromonas hydrophila subsp. hydrophila ATCC 7966] | 1.18E+08 | 0 | Aeromonas hydrophila subsp. hydrophila ATCC 7966 | Empedobacter brevis mature peptide synthesizing enzyme SEQ ID NO: 3. | AED10581 1.00E-131 |
| 173, 174 | alanine racemase [Aeromonas hydrophila subsp. hydrophila ATCC 7966] | 1.18E+08 | 0 | Aeromonas hydrophila subsp. hydrophila ATCC 7966 | Empedobacter brevis mature peptide synthesizing enzyme SEQ ID NO: 3. | AED10581 1.00E-129 |
| 175, 176 | alanine racemase [Aeromonas hydrophila subsp. hydrophila ATCC 7966] | 1.18E+08 | 0 | Aeromonas hydrophila subsp. hydrophila ATCC 7966 | Empedobacter brevis mature peptide synthesizing enzyme SEQ ID NO: 3. | AED10581 1.00E-130 |
| 177, 178 | alanine racemase [Aeromonas hydrophila subsp. | 1.18E+08 | 0 | Aeromonas hydrophila subsp. | Empedobacter brevis mature | AED10581 1.00E-132 |

TABLE 3-continued

| | | | | |
|---|---|---|---|---|
| hydrophila ATCC 7966] | | hydrophila ATCC 7966 | peptide synthesizing enzyme SEQ ID NO: 3. | |
| 179, 180 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 181, 182 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-130 |
| 183, 184 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 185, 186 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-129 |
| 187, 188 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 189, 190 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 191, 192 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 193, 194 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |

TABLE 3-continued

| | | | | |
|---|---|---|---|---|
| 195, alanine racemase 196 [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-131 |
| 197, alanine racemase 198 [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-131 |
| 199, alanine racemase 200 [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-130 |
| 201, alanine racemase 202 [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-129 |
| 203, alanine racemase 204 [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-130 |
| 205, alanine racemase 206 [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-130 |
| 207, alanine racemase 208 [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-133 |
| 209, alanine racemase 210 [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-131 |
| 211, alanine racemase 212 [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing | AED105811.00E-131 |

TABLE 3-continued

| | | | | | |
|---|---|---|---|---|---|
| 213, 214 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-133 |
| 215, 216 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-130 |
| 217, 218 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 219, 220 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-129 |
| 221, 222 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-128 |
| 223, 224 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-133 |
| 225, 226 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-130 |
| 227, 228 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 229, 230 | alanine racemase [Aeromonas hydrophila subsp. hydrophila ATCC | 1.18E+080 | Aeromonas hydrophila subsp. hydrophila | Empedobacter brevis mature peptide | AED105811.00E-130 |

TABLE 3-continued

| | | | | | |
|---|---|---|---|---|---|
| 7966] | | | ATCC 7966 | synthesizing enzyme SEQ ID NO: 3. | |
| 231, 232 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-130 |
| 233, 234 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-128 |
| 235, 236 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-128 |
| 237, 238 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-128 |
| 239, 240 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-128 |
| 241, 242 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-130 |
| 243, 244 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-129 |
| 245, 246 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-129 |
| 247, 248 | alanine racemase [Aeromonas hydrophila subsp. | 1.18E+080 | Aeromonas hydrophila subsp. | Empedobacter brevis mature | AED105811.00E-130 |

TABLE 3-continued

| | | | | | |
|---|---|---|---|---|---|
| hydrophila ATCC 7966] | | | hydrophila ATCC 7966 | peptide synthesizing enzyme SEQ ID NO: 3. | |
| 249, 250 alanine racemase [Aeromonas hydrophila subsp. hydrophila ATCC 7966] | 1.18E+08 | 0 | Aeromonas hydrophila subsp. hydrophila ATCC 7966 | Empedobacter brevis mature peptide synthesizing enzyme SEQ ID NO: 3. | AED10581 1.00E-129 |
| 251, 252 alanine racemase [Aeromonas hydrophila subsp. hydrophila ATCC 7966] | 1.18E+08 | 0 | Aeromonas hydrophila subsp. hydrophila ATCC 7966 | Empedobacter brevis mature peptide synthesizing enzyme SEQ ID NO: 3. | AED10581 1.00E-130 |
| 253, 254 alanine racemase [Aeromonas hydrophila subsp. hydrophila ATCC 7966] | 1.18E+08 | 0 | Aeromonas hydrophila subsp. hydrophila ATCC 7966 | Empedobacter brevis mature putida synthesizing enzyme SEQ ID NO: 3. | AED10581 1.00E-129 |
| 255, 256 hypothetical protein [Mesorhizobium loti]. | 13474743 | 1.00E-170 | Mesorhizobium loti | Propionibacterium acnes predicted ORF-encoded polypeptide #300. | ABM37068 1.00E-77 |
| 257, 258 alanine racemase [Aeromonas salmonicida subsp. salmonicida A449] | 1.45E+08 | 0 | Aeromonas salmonicida subsp. salmonicida A449 | Empedobacter brevis mature peptide synthesizing enzyme SEQ ID NO: 3. | AED10581 1.00E-129 |
| 259, 260 alanine racemase [Aeromonas salmonicida subsp. salmonicida A449] | 1.45E+08 | 0 | Aeromonas salmonicida subsp. salmonicida A449 | Empedobacter brevis mature peptide synthesizing enzyme SEQ ID NO: 3. | AED10581 1.00E-130 |
| 261, 262 alanine racemase [Aeromonas salmonicida subsp. salmonicida A449] | 1.45E+08 | 0 | Aeromonas salmonicida subsp. salmonicida A449 | Empedobacter brevis mature peptide synthesizing enzyme SEQ ID NO: 3. | AED10581 1.00E-130 |
| 263, 264 alanine racemase [Aeromonas salmonicida subsp. salmonicida A449] | 1.45E+08 | 0 | Aeromonas salmonicida subsp. salmonicida A449 | Empedobacter brevis mature peptide synthesizing enzyme SEQ ID NO: 3. | AED10581 1.00E-128 |
| 265, 266 alanine racemase [Aeromonas salmonicida | 1.45E+08 | 0 | Aeromonas salmonicida subsp. | Empedobacter brevis mature | AED10581 1.00E-129 |

TABLE 3-continued

| | | | | | |
|---|---|---|---|---|---|
| subsp. salmonicida A449] | | | salmonicida A449 | peptide synthesizing enzyme SEQ ID NO: 3. | |
| 267, 268 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-129 |
| 269, 270 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 271, 272 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 273, 274 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-130 |
| 275, 276 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-128 |
| 277, 278 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-133 |
| 279, 280 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 281, 282 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |

TABLE 3-continued

| | | | | | |
|---|---|---|---|---|---|
| 283, 284 | alanine racemase [Aeromonas hydrophila subsp. hydrophila ATCC 7966] | 1.18E+08 0 | Aeromonas hydrophila subsp. hydrophila ATCC 7966 | Empedobacter brevis mature peptide synthesizing enzyme SEQ ID NO: 3. | AED10581 1.00E-132 |
| 285, 286 | alanine racemase [Aeromonas salmonicida subsp. salmonicida A449] | 1.45E+08 0 | Aeromonas salmonicida subsp. salmonicida A449 | Empedobacter brevis mature peptide synthesizing enzyme SEQ ID NO: 3. | AED10581 1.00E-130 |
| 287, 288 | alanine racemase [Aeromonas salmonicida subsp. salmonicida A449] | 1.45E+08 0 | Aeromonas salmonicida subsp. salmonicida A449 | Empedobacter brevis mature peptide synthesizing enzyme SEQ ID NO: 3. | AED10581 1.00E-129 |
| 289, 290 | alanine racemase [Aeromonas salmonicida subsp. salmonicida A449] | 1.45E+08 0 | Aeromonas salmonicida subsp. salmonicida A449 | Empedobacter brevis mature peptide synthesizing enzyme SEQ ID NO: 3. | AED10581 1.00E-129 |
| 291, 292 | alanine racemase [Aeromonas hydrophila subsp. hydrophila ATCC 7966] | 1.18E+08 0 | Aeromonas hydrophila subsp. hydrophila ATCC 7966 | Empedobacter brevis mature peptide synthesizing enzyme SEQ ID NO: 3. | AED10581 1.00E-131 |
| 293, 294 | alanine racemase [Aeromonas salmonicida subsp. salmonicida A449] | 1.45E+08 0 | Aeromonas salmonicida subsp. salmonicida A449 | Empedobacter brevis mature peptide synthesizing enzyme SEQ ID NO: 3. | AED10581 1.00E-127 |
| 295, 296 | alanine racemase [Aeromonas hydrophila subsp. hydrophila ATCC 7966] | 1.18E+08 0 | Aeromonas hydrophila subsp. hydrophila ATCC 7966 | Empedobacter brevis mature peptide synthesizing enzyme SEQ ID NO: 3. | AED10581 1.00E-129 |
| 297, 298 | proline racemase [Burkholderia phymatum STM815] gi\|117982269\|gb\|EAU96656.1\| proline racemase [Burkholderia phymatum STM815] | 1.18E+08 1.00E-104 | Burkholderia phymatum STM815 | Acinetobacter baumannii protein #19. | ADA35228 1.00E-105 |
| 299, 300 | alanine racemase [Pseudomonas putida GB-1] gi\|126314851\|gb\|EAZ66019.1\| | 1.26E+08 1.00E-170 | Pseudomonas putida GB-1 | T. maritima D-alanine-D-alanine ligase. | AED11803 1.00E-169 |

TABLE 3-continued

| SEQ ID | Description | GI/E-value | Organism | Homolog | Accession/E-value |
|---|---|---|---|---|---|
| | alanine racemase [*Pseudomonas putida* GB-1] | | | | |
| 301, 302 | alanine racemase [*Pseudomonas putida* KT2440] | 26990430 1.00E-143 | *Pseudomonas putida* KT2440 | *T. maritima* D-alanine-D-alanine ligase. | AED11803 1.00E-144 |
| 303, 304 | hypothetical protein PaerP_01003954 [*Pseudomonas aeruginosa* PA7] | 94414235 4.00E-33 | *Pseudomonas aeruginosa* PA7 | *Pseudomonas aeruginosa* polypeptide #3. | ABO82155 4.00E-33 |
| 305, 306 | AGR_L_3051p [*Agrobacterium tumefaciens*]. | 15891641 1.00E-128 | *Agrobacterium tumefaciens* | *L. pneumophila* protein SEQ ID NO 3367. | AEB41596 3.00E-39 |
| 307, 308 | proline racemase [*Microscilla marina* ATCC 23134] gi\|123984081\|gb\|EAY24454.1\| proline racemase [*Microscilla marina* ATCC 23134] | 1.24E+08 3.00E-59 | *Microscilla marina* ATCC 23134 | Bacterial polypeptide #10001. | ADS22995 3.00E-47 |
| 309, 310 | alanine racemase [*Stenotrophomonas maltophilia* R551-3] gi\|119820021\|gb\|EAX22642.1\| alanine racemase [*Stenotrophomonas maltophilia* R551-3] | 1.2E+08 2.00E-57 | *Stenotrophomonas maltophilia* R551-3 | Prokaryotic essential gene #34740. | ABU41398 8.00E-52 |
| 311, 312 | mandelate racemase/muconate lactonizing enzyme family protein [*Sulfitobacter* sp. NAS-14.1] gi\|83842294\|gb\|EAP81462.1\| mandelate racemase/muconate lactonizing enzyme family protein [*Sulfitobacter* sp. NAS-14.1] | 83953326 1.00E-143 | *Sulfitobacter* sp. NAS-14.1 | *Klebsiella pneumonia* polypeptide seqid 7178. | ABO61307 2.00E-71 |
| 313, 314 | proline racemase [*Mesorhizobium loti*]. | 13473394 1.00E-120 | *Mesorhizobium loti* | Bacterial polypeptide #10001. | ADS22995 1.00E-120 |
| 315, 316 | proline racemase [*Flavobacteriales bacterium* HTCC2170] gi\|88708932\|gb\|EAR01166.1\| proline racemase [*Flavobacteriales bacterium* HTCC2170] | 88712394 1.00E-106 | *Flavobacteriales bacterium* HTCC2170 | Bacterial polypeptide #10001. | ADS22995 1.00E-72 |
| 317, 318 | Mandelate racemase/muconate lactonizing enzyme [*Flavobacteriales bacterium* HTCC2170] gi\|88709134\|gb\|EAR01368.1\| Mandelate racemase/muconate lactonizing enzyme | 88712596 1.00E-110 | *Flavobacteriales bacterium* HTCC2170 | *Bacteroides fragilis* strain 14062 protein, SEQ: 5227. | AEX28600 5.00E-34 |

TABLE 3-continued

| | | | | | |
|---|---|---|---|---|---|
| [*Flavobacteriales bacterium* HTCC2170] | | | | | |
| 319, 320 | COG3938: Proline racemase [*Pseudomonas aeruginosa* C3719] gi\|84328204\|ref\| ZP_00976211.1\| COG3938: Proline racemase [*Pseudomonas aeruginosa* 2192] gi\|107100719\|ref\| ZP_01364637.1\| hypothetical protein PaerPA_01001746 [*Pseudomonas aeruginosa* PACS2] gi\|12616632 | 8432195 1.00E-60 | *Pseudomonas aeruginosa* C3719 | *Pseudomonas aeruginosa* polypeptide #3. | ABO82155 4.00E-61 |
| 321, 322 | aspartate racemase [*Pyrococcus abyssi*]. | 1452157 5 2.00E-28 | *Pyrococcus abyssi* | *Thermococcus kodakaraensis* KOD1 protein sequence SeqID4. | ADN46207 7.00E-25 |
| 323, 324 | proline racemase, putative [*Psychroflexus torquis* ATCC 700755] gi\|91184469\|gb\|EAS70852.1\| proline racemase, putative [*Psychroflexus torquis* ATCC 700755] | 9121736 1.00E-152 | *Psychroflexus torquis* ATCC 700755 | Bacterial polypeptide #10001. | ADS22995 1.00E-110 |
| 325, 326 | proline racemase [*Microscilla marina* ATCC 23134] gi\|123984081\|gb\|EAY24454.1\| proline racemase [*Microscilla marina* ATCC 23134] | 1.24E+08 1.00E-145 | *Microscilla marina* ATCC 23134 | Bacterial polypeptide #10001. | ADS22995 1.00E-126 |
| 327, 328 | proline racemase [*Microscilla marina* ATCC 23134] gi\|123984081\|gb\|EAY24454.1\| proline racemase [*Microscilla marina* ATCC 23134] | 1.24E+08 1.00E-147 | *Microscilla marina* ATCC 23134 | Bacterial polypeptide #10001. | ADS22995 1.00E-132 |
| 329, 330 | putative proline racemase [*Myxococcus xanthus* DK 1622] | 1.09E+08 1.00E-101 | *Myxococcus xanthus* DK 1622 | *M. xanthus* protein sequence, seq id 9726. | ABM96637 1.00E-101 |
| 331, 332 | AGR_L_3051p [*Agrobacterium tumefaciens*]. | 1589164 7.00E-44 | *Agrobacterium tumefaciens* | Bacterial polypeptide #19. | ADF07948 5.00E-21 |
| 333, 334 | putative alanine racemase [*Rhizobium leguminosarum* bv. *viciae* 3841] | 1.16E+08 9.00E-97 | *Rhizobium leguminosarum* bv. *viciae* 3841 | Bacterial polypeptide #19. | ADF07948 6.00E-29 |
| 335, 336 | alanine racemase [*Moorella thermoacetica* ATCC 39073] | 8359099 05.00E-78 | *Moorella thermoacetica* ATCC 39073 | Prokaryotic essential gene #34740. | ABU24721 1.00E-63 |

TABLE 3-continued

| | | | | | |
|---|---|---|---|---|---|
| 337, 338 | alanine racemase [*Moorella thermoacetica* ATCC 39073] | 83590990 | 3.00E-77 | *Moorella thermoacetica* ATCC 39073 | Prokaryotic essential gene #34740. | ABU2472 1.00E-60 |
| 339, 340 | Alanine racemase [*Azotobacter vinelandii* AvOP] gi\|67087270\|gb\|EAM06737.1\| Alanine racemase [*Azotobacter vinelandii* AvOP] | 67155469 | 1.00E-115 | *Azotobacter vinelandii* AvOP | Prokaryotic essential gene #34740. | ABU3979 5.00E-115 |
| 341, 342 | mandelate racemase/muconate lactonizing enzyme [*Sphingopyxis alaskensis* RB2256] | 1.03E+08 | 2.00E-99 | *Sphingopyxis alaskensis* RB2256 | *Klebsiella pneumoniae* polypeptide seqid 7178. | ABO6130 7.1.00E-45 |
| 343, 344 | putative alanine racemase [*Rhizobium leguminosarum* bv. viciae 3841] | 1.16E+08 | 1.00E-127 | *Rhizobium leguminosarum* bv. viciae 3841 | *Pseudomonas aeruginosa* polypeptide #3. | ABO8427 4 8.00E-42 |
| 345, 346 | AGR_L_3051p [*Agrobacterium tumefaciens*]. | 15891641 | 2.00E-79 | *Agrobacterium tumefaciens* | *Photorhabdus luminescens* protein sequence #59. | ABM6911 4 1.00E-27 |
| 347, 348 | putative alanine racemase [*Rhizobium leguminosarum* bv. viciae 3841] | 1.16E+08 | 1.00E-114 | *Rhizobium leguminosarum* bv. viciae 3841 | Prokaryotic essential gene #34740. | ABU4139 8 1.00E-36 |
| 349, 350 | Mandelate racemase/muconate lactonizing enzyme; C-terminal domain protein [*Methylobacterium* sp. 4-46] | 1.49E+08 | 2.00E-87 | *Methylobacterium* sp. 4-46 | *Klebsiella pneumoniae* polypeptide seqid 7178. | ABO6130 7 1.00E-63 |
| 351, 352 | Mandelate racemase/muconate lactonizing enzyme; C-terminal domain protein [*Sphingomonas wittichii* RW1] | 1.49E+08 | 3.00E-93 | *Sphingomonas wittichii* RW1 | *Klebsiella pneumoniae* polypeptide seqid 7178. | ABO6130 7 3.00E-48 |
| 353, 354 | putative proline racemase [*Burkholderia xenovorans* LB400] | 91779222 | 1.00E-38 | *Burkholderia xenovorans* LB400 | Prokaryotic essential gene #34740. | ABU2181 3 3.00E-39 |
| 355, 356 | alanine racemase [*Lentisphaera araneosa* HTCC2155] | 1.49E+08 | 2.00E-67 | *Lentisphaera araneosa* HTCC2155 | Prokaryotic essential gene #34740. | ABU2392 1 1.00E-56 |
| 357, 358 | alanine racemase [*Roseiflexus castenholzii* DSM 13941] gi\|118010932\|gb\|EAV24951.1\| alanine racemase [*Roseiflexus castenholzii* DSM 13941] | 1.18E+08 | 1.00E-107 | *Roseiflexus castenholzii* DSM 13941 | Prokaryotic essential gene #34740. | ABU2392 1 5.00E-75 |

TABLE 3-continued

| | | | | | |
|---|---|---|---|---|---|
| 359, 360 | alanine racemase [*Roseiflexus castenholzii* DSM 13941] gi\|118010932\|gb\|EAV24951.1\| alanine racemase [*Roseiflexus castenholzii* DSM 13941] | 1.18E+08 1.00E-107 | *Roseiflexus castenholzii* DSM 13941 | Prokaryotic essential gene #34740. | ABU23921 1.00E-75 |
| 361, 362 | alanine racemase [*Roseiflexus castenholzii* DSM 13941] gi\|118010932\|gb\|EAV24951.1\| alanine racemase [*Roseiflexus castenholzii* DSM 13941] | 1.18E+08 1.00E-107 | *Roseiflexus castenholzii* DSM 13941 | Prokaryotic essential gene #34740. | ABU23921 5.00E-75 |
| 363, 364 | alanine racemase [*Roseiflexus castenholzii* DSM 13941] gi\|118010932\|gb\|EAV24951.1\| alanine racemase [*Roseiflexus castenholzii* DSM 13941] | 1.18E+08 1.00E-107 | *Roseiflexus castenholzii* DSM 13941 | Prokaryotic essential gene #34740. | ABU23921 3.00E-75 |
| 365, 366 | alanine racemase [*Roseiflexus castenholzii* DSM 13941] gi\|118010932\|gb\|EAV24951.1\| alanine racemase [*Roseiflexus castenholzii* DSM 13941] | 1.18E+08 1.00E-107 | *Roseiflexus castenholzii* DSM 13941 | Prokaryotic essential gene #34740. | ABU23921 3.00E-76 |
| 367, 368 | alanine racemase [*Pseudomonas mendocina* ymp] | 1.46E+08 1.00E-168 | *Pseudomonas mendocina* ymp | Prokaryotic essential gene #34740. | ABU41398 1.00E-160 |
| 369, 370 | diaminopimelate epimerase [*Nostoc* sp. PCC 7120]. | 172323333.00E-78 | *Nostoc* sp. PCC 7120 | Bacterial polypeptide #10001. | ADS29848 9.00E-79 |
| 371, 372 | diaminopimelate epimerase [*Syntrophus aciditrophicus* SB] | 858579162.00E-76 | *Syntrophus aciditrophicus* SB | Bacterial polypeptide #10001. | ADN17489 5.00E-60 |
| 373, 374 | diaminopimelate epimerase [*Nostoc* sp. PCC 7120]. | 172323332.00E-71 | *Nostoc* sp. PCC 7120 | Bacterial polypeptide #10001. | ADS29848 7.00E-72 |
| 375, 376 | Diaminopimelate epimerase [*Clostridium thermocellum* ATCC 27405] | 1.26E+08 5.00E-33 | *Clostridium thermocellum* ATCC 27405 | Bacterial polypeptide #10001. | ADN27169 2.00E-31 |
| 377, 378 | UDP-N-acetylglucosamine 2-epimerase [*Chloroflexus aggregans* DSM 9485] gi\|117997290\|gb\|EAV11478.1\| UDP-N-acetylglucosamine 2-epimerase [*Chloroflexus aggregans* DSM 9485] | 1.18E+08 2.00E-97 | *Chloroflexus aggregans* DSM 9485 | Prokaryotic essential gene #34740. | ABU24769 6.00E-80 |

TABLE 3-continued

| | | | | | | |
|---|---|---|---|---|---|---|
| 379, 380 | NmrA family protein [Burkholderia vietnamiensis G4] | 1.34E+08 | 2.00E-88 | Burkholderia vietnamiensis G4 | Bacterial polypeptide #10001. | ADS22779 2.00E-84 |
| 381, 382 | hypothetical protein RL1205 [Rhizobium leguminosarum by. viciae 3841] | 1.16E+08 | 2.00E-87 | Rhizobium leguminosarum by. viciae 3841 | Bacterial polypeptide #10001. | ADS22779 1.00E-83 |
| 383, 384 | similar to chloromuconate cycloisomerase [Gloeobacter violaceus PCC 7421] | 37522668 | 1.00E-93 | Gloeobacter violaceus PCC 7421 | L. pneumophila protein SEQ ID NO 3367. | AEB37282 4.00E-48 |

| SEQ ID NO: | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|
| 1, 2 | Drosophila melanogaster polypeptide SEQ ID NO 124465. | ABL03829 | 0.48 | 2.7.3. | 687 | 228 | 687 | 228 | 100 | 100 |
| 3, 4 | Aquifex pyrophilus heat resistant alanine racemase encoding DNA. | ABL49607 | 2.00E-07 | 5.1.1.1 | 1017 | 338 | 0 | 338 | 100 | |
| 5, 6 | Human immune/haematopoietic antigen genomic sequence SEQ ID NO: 41436. | AAK80650 | 0.032 | 2.7.3. | 720 | 239 | 0 | 239 | 80 | |
| 7, 8 | EST clone EP219. | AAV88076 | 0.048 | | 1032 | 343 | 0 | 343 | 89 | |
| 9, 10 | Pseudomonas aeruginosa polypeptide #3. | ABD08732 | 1.00E-05 | 5.1.1.1 | 1149 | 382 | 0 | 391 | 78 | |
| 11, 12 | Pseudomonas aeruginosa polypeptide #3. | ABD06378 | 0.013 | 5.1.1.1 | 1122 | 373 | 0 | 388 | 58 | |
| 13, 14 | Pseudomonas aeruginosa polypeptide #3. | ABD08732 | 1.00E-08 | 5.1.1.1 | 1065 | 354 | 0 | 353 | 64 | |
| 15, 16 | Klebsiella pneumoniae polypeptide seqid 7178. | ACH99054 | 0.002 | 5.1.1.13 | 702 | 233 | 0 | 231 | 74 | |
| 17, 18 | Human phosphodiesterase 4D amino acid sequence N1 SEQ ID NO: 7. | AEB85185 | 0.009 | 5.1.1.3 | 807 | 268 | 0 | 269 | 72 | |

TABLE 3-continued

| | | | | | | | | | |
|---|---|---|---|---|---|---|---|---|---|
| 19, 20 | *M. xanthus* protein sequence, seq id 9726. | ACL64794 | 0.037 | 5.1.1.3 | 822 | 273 | 0 | 272 | 53 |
| 21, 22 | Bacterial polypeptide #10001. | ADS61806 | 1.00E-04 | 5.2.1.1 | 768 | 255 | 0 | 265 | 41 |
| 23, 24 | *Enterobacter cloacae* protein amino acid sequence - SEQ ID 5666. | AEH55699 | 0 | 5.1.1.1 | 1080 | 359 | 0 | 359 | 95 |
| 25, 26 | *Enterobacter cloacae* protein amino acid sequence - SEQ ID 5666. | AEH55699 | 0 | 5.1.1.1 | 1080 | 359 | 0 | 359 | 95 |
| 27, 28 | Prokaryotic essential gene #34740. | ACA27845 | 0.002 | 2.7.3. | 651 | 216 | 0 | 216 | 100 |
| 29, 30 | *Pseudomonas aeruginosa* polypeptide #3. | ABD15676 | 1.00E-08 | 5.1.1.4 | 1032 | 343 | 0 | 342 | 64 |
| 31, 32 | *Pseudomonas aeruginosa* polypeptide #3. | ABD15666 | 9.00E-16 | 5.1.1.4 | 1011 | 336 | 0 | 310 | 58 |
| 33, 34 | Human cancer associated cDNA SEQ ID NO 9. | AEH98530 | 0.013 | 5.1.1.1 | 1116 | 371 | 0 | 385 | 61 |
| 35, 36 | *N. meningitidis* partial DNA sequence gnm_640 SEQ ID NO: 640. | AAA81486 | 3.2 | 5.1.1. | 1101 | 366 | 0 | 368 | 33 |
| 37, 38 | *Pseudomonas aeruginosa* polypeptide #3. | ABD12586 | 0.32 | 5.1.1.1. | 489 | 162 | 0 | 369 | 51 |
| 39, 40 | Prokaryotic essential gene #34740. | ACA26332 | 8.00E-23 | 5.1.1.4 | 372 | 123 | 960 | 318 | |
| 41, 42 | *Pseudomonas putida* racemase peptide, SEQ ID 5. | ADB99538 | 0 | 5.1.1.1 | 1230 | 409 | 0 | 409 | 97 |
| 43, 44 | *Pseudomonas putida* racemase peptide, SEQ ID 5. | ADB99538 | 0 | 5.1.1.1 | 1230 | 409 | 0 | 409 | 96 |

TABLE 3-continued

| | | | | | | | | | |
|---|---|---|---|---|---|---|---|---|---|
| 45, 46 | *Pseudomonas putida* racemase peptide, SEQ ID 5. | ADB99538 | 0 | 5.1.1.1 | 1230 | 409 | 0 | 409 | 97 |
| 47, 48 | *Pseudomonas putida* racemase peptide, SEQ ID 5. | ADB99538 | 0 | 5.1.1.1 | 1230 | 409 | 0 | 409 | 97 |
| 49, 50 | *Pseudomonas putida* racemase peptide, SEQ ID 5. | ADB99538 | 0 | 5.1.1.1 | 1230 | 409 | 0 | 409 | 96 |
| 51, 52 | *Pseudomonas putida* racemase peptide, SEQ ID 5. | ADB99537 | 1.00E-120 | 5.1.1.1 | 1230 | 409 | 0 | 409 | 77 |
| 53, 54 | *Pseudomonas putida* racemase peptide, SEQ ID 5. | ADB99537 | 1.00E-124 | 5.1.1.1 | 1230 | 409 | 0 | 409 | 77 |
| 55, 56 | *Pseudomonas putida* racemase peptide, SEQ ID 5. | ADB99537 | 1.00E-124 | 5.1.1.1 | 1230 | 409 | 0 | 409 | 77 |
| 57, 58 | *Pseudomonas putida* racemase peptide, SEQ ID 5. | ADB99538 | 0 | 5.1.1.1 | 1230 | 409 | 0 | 409 | 96 |
| 59, 60 | *Pseudomonas putida* racemase peptide, SEQ ID 5. | ADB99538 | 0 | 5.1.1.1 | 1230 | 409 | 0 | 409 | 95 |
| 61, 62 | Human prostate expression marker cDNA 6604. | ABV52203 | 0.077 | 5.1.1.1 | 1614 | 537 | 0 | 354 | 19 |
| 63, 64 | *Pseudomonas putida* racemase peptide, SEQ ID 5. | ADB99537 | 0 | 5.1.1.1 | 1230 | 409 | 0 | 409 | 98 |
| 65, 66 | *Pseudomonas putida* racemase peptide, SEQ ID 5. | ADB99537 | 0 | 5.1.1.1 | 1230 | 409 | 0 | 409 | 97 |
| 67, 68 | *Pseudomonas putida* racemase peptide, SEQ ID 5. | ADB99538 | 0 | 5.1.1.1 | 1230 | 409 | 0 | 409 | 90 |
| 69, 70 | *Pseudomonas putida* racemase peptide, SEQ ID 5. | ADB99537 | 0 | 5.1.1.1 | 1230 | 409 | 0 | 409 | 95 |

TABLE 3-continued

| | | | | | | | | | |
|---|---|---|---|---|---|---|---|---|---|
| 71, 72 | *Pseudomonas putida* racemase peptide, SEQ ID 5. | ADB99537 | 0 | 5.1.1.1 | 1230 | 409 | 0 | 409 | 96 |
| 73, 74 | *Pseudomonas putida* racemase peptide, SEQ ID 5. | ADB99537 | 0 | 5.1.1.1 | 1230 | 409 | 0 | 409 | 95 |
| 75, 76 | *Pseudomonas putida* racemase peptide, SEQ ID 5. | ADB99537 | 0 | 5.1.1.1 | 1230 | 409 | 0 | 409 | 95 |
| 77, 78 | *Pseudomonas putida* racemase peptide, SEQ ID 5. | ADB99538 | 0 | 5.1.1.1 | 1230 | 409 | 0 | 409 | 95 |
| 79, 80 | *Pseudomonas putida* racemase peptide, SEQ ID 5. | ADB99538 | 0 | 5.1.1.1 | 1230 | 409 | 0 | 409 | 95 |
| 81, 82 | *Pseudomonas putida* racemase peptide, SEQ ID 5. | ADB99538 | 0 | 5.1.1.1 | 1230 | 409 | 0 | 409 | 96 |
| 83, 84 | *Pseudomonas putida* racemase peptide, SEQ ID 5. | ADB99538 | 0 | 5.1.1.1 | 1230 | 409 | 0 | 409 | 94 |
| 85, 86 | *Pseudomonas putida* racemase peptide, SEQ ID 5. | ADB99537 | 0 | 5.1.1.1 | 1230 | 409 | 0 | 409 | 96 |
| 87, 88 | *Pseudomonas putida* racemase peptide, SEQ ID 5. | ADB99538 | 0 | 5.1.1.1 | 1230 | 409 | 0 | 409 | 96 |
| 89, 90 | *Pseudomonas putida* racemase peptide, SEQ ID 5. | ADB99537 | 0 | 5.1.1.1 | 1230 | 409 | 0 | 409 | 96 |
| 91, 92 | *Pseudomonas putida* racemase peptide, SEQ ID 5. | ADB99538 | 0 | 5.1.1.1 | 1230 | 409 | 0 | 409 | 96 |
| 93, 94 | *Pseudomonas putida* racemase peptide, SEQ ID 5. | ADB99538 | 0 | 5.1.1.1 | 1230 | 409 | 0 | 409 | 96 |
| 95, 96 | *Pseudomonas putida* racemase peptide, SEQ ID 5. | ADB99537 | 0 | 5.1.1.1 | 1230 | 409 | 0 | 409 | 95 |

TABLE 3-continued

| | | | | | | | | | |
|---|---|---|---|---|---|---|---|---|---|
| 97, 98 | *Pseudomonas putida* racemase peptide, SEQ ID 5. | ADB99537 | 0 | 5.1.1.1 | 1230 | 409 | 0 | 409 | 96 |
| 99, 100 | *Pseudomonas putida* racemase peptide, SEQ ID 5. | ADB99537 | 0 | 5.1.1.1 | 1230 | 409 | 0 | 409 | 97 |
| 101, 102 | *Enterobacter cloacae* protein amino acid sequence - SEQ ID 5666. | AEH53103 | 5.00E-27 | 5.1.1.1 | 384 | 127 | 1071 | 356 | 86 | 76 |
| 103, 104 | Prokaryotic essential gene #34740. | ACA27539 | 0.13 | 5.1.1.13 | 714 | 237 | 687 | 228 | 32 | 48 |
| 105, 106 | Bovine ABCG2 related PCR primer #31. | AEN69487 | 2.9 | 5.1.1.4 | 1002 | 333 | 0 | 333 | 75 |
| 107, 108 | *Pseudomonas putida* racemase peptide, SEQ ID 5. | ADB99538 | 6.00E-11 | 5.1.1.1 | 1227 | 408 | 0 | 408 | 96 |
| 109, 110 | *Pseudomonas putida* racemase peptide, SEQ ID 5. | ADB99538 | 6.00E-05 | 5.1.1.1 | 1227 | 408 | 0 | 408 | 95 |
| 111, 112 | *Pseudomonas putida* racemase peptide, SEQ ID 5. | ADB99538 | 2.00E-11 | 5.1.1.1 | 1227 | 408 | 0 | 408 | 99 |
| 113, 114 | *Pseudomonas putida* racemase peptide, SEQ ID 5. | ADB99538 | 2.00E-14 | 5.1.1.1 | 1224 | 407 | 0 | 408 | 92 |
| 115, 116 | *Pseudomonas putida* racemase peptide, SEQ ID 5. | ADB99538 | 2.00E-08 | 5.1.1.1 | 1227 | 408 | 0 | 408 | 92 |
| 117, 118 | *Pseudomonas putida* racemase peptide, SEQ ID 5. | ADB99538 | 6.00E-11 | 5.1.1.1 | 1227 | 408 | 0 | 408 | 92 |
| 119, 120 | *Pseudomonas putida* racemase peptide, SEQ ID 5. | ADB99538 | 1.00E-12 | 5.1.1.1 | 1227 | 408 | 0 | 408 | 95 |

TABLE 3-continued

| | | | | | | | | |
|---|---|---|---|---|---|---|---|---|
| 121, 122 | *Pseudomonas putida* racemase peptide, SEQ ID 5. | ADB99538 | 2.00E-26 | 5.1.1.1 | 1086 | 361 | 1227 | 409 |
| 123, 124 | *Pseudomonas putida* racemase peptide, SEQ ID 5. | ADB99538 | 6.00E-11 | 5.1.1.1 | 1086 | 361 | 0 | 408 | 88 |
| 125, 126 | *Pseudomonas putida* racemase peptide, SEQ ID 5. | ADB99538 | 4.00E-95 | 5.1.1.1 | 1086 | 361 | 1227 | 386 |
| 127, 128 | Prokaryotic essential gene #34740. | ACA37866 | 2.2 | 5.1.1.3 | 261 | 86 | 0 | 265 | 63 |
| 129, 130 | Prokaryotic essential gene #34740. | ACA26332 | 5.00E-11 | 5.1.1.4 | 957 | 318 | 0 | 310 | 56 |
| 131, 132 | Prokaryotic essential gene #34740. | ACA26332 | 1.00E-18 | 5.1.1.4 | 1074 | 357 | 960 | 311 |
| 133, 134 | *Pseudomonas putida* racemase peptide, SEQ ID 5. | ADB99538 | 6.00E-11 | 5.1.1.1 | 1227 | 408 | 0 | 408 | 99 |
| 135, 136 | *Pseudomonas putida* racemase peptide, SEQ ID 5. | ADB99538 | 6.00E-05 | 5.1.1.1 | 1227 | 408 | 0 | 408 | 95 |
| 137, 138 | *Pseudomonas putida* racemase peptide, SEQ ID 5. | ADB99538 | 0.004 | 5.1.1.1 | 1221 | 406 | 0 | 408 | 95 |
| 139, 140 | *Pseudomonas putida* racemase peptide, SEQ ID 5. | ADB99538 | 6.00E-11 | 5.1.1.1 | 1224 | 407 | 0 | 408 | 99 |
| 141, 142 | *Pseudomonas putida* racemase peptide, SEQ ID 5. | ADB99538 | 1.00E-15 | 5.1.1.1 | 1227 | 408 | 0 | 408 | 89 |
| 143, 144 | *Pseudomonas putida* racemase peptide, SEQ ID 5. | ADB99538 | 6.00E-11 | 5.1.1.1 | 1227 | 408 | 0 | 408 | 100 |
| 145, 146 | *Pseudomonas putida* racemase peptide, SEQ ID 5. | ADB99538 | 2.00E-11 | 5.1.1.1 | 1224 | 407 | 0 | 408 | 99 |

TABLE 3-continued

| | | | | | | | | | |
|---|---|---|---|---|---|---|---|---|---|
| 147, 148 | *Pseudomonas putida* racemase peptide, SEQ ID 5. | ADB99538 | 3.00E-19 | 5.1.1.1 | 1224 | 407 | 0 | 408 | 97 |
| 149, 150 | *Pseudomonas putida* racemase peptide, SEQ ID 5. | ADB99538 | 6.00E-11 | 5.1.1.1 | 1227 | 408 | 0 | 408 | 93 |
| 151, 152 | *Pseudomonas putida* racemase peptide, SEQ ID 5. | ADB99538 | 3.00E-19 | 5.1.1.1 | 1227 | 408 | 0 | 408 | 92 |
| 153, 154 | *Pseudomonas putida* racemase peptide, SEQ ID 5. | ADB99538 | 3.00E-19 | 5.1.1.1 | 1224 | 407 | 0 | 408 | 97 |
| 155, 156 | *Pseudomonas putida* racemase peptide, SEQ ID 5. | ADB99538 | 2.00E-14 | 5.1.1.1 | 1227 | 408 | 0 | 408 | 96 |
| 157, 158 | *Pseudomonas putida* racemase peptide, SEQ ID 5. | ADB99538 | 6.00E-11 | 5.1.1.1 | 1227 | 408 | 0 | 408 | 92 |
| 159, 160 | *Pseudomonas putida* racemase peptide, SEQ ID 5. | ADB99538 | 6.00E-11 | 5.1.1.1 | 1227 | 408 | 0 | 408 | 92 |
| 161, 162 | *Pseudomonas putida* racemase peptide, SEQ ID 5. | ADB99538 | 3.00E-19 | 5.1.1.1 | 1227 | 408 | 0 | 408 | 97 |
| 163, 164 | *Pseudomonas putida* racemase peptide, SEQ ID 5. | ADB99538 | 1.00E-64 | 5.1.1.1 | 1086 | 361 | 1227 | 386 | |
| 165, 166 | *Pseudomonas putida* racemase peptide, SEQ ID 5. | ADB99538 | 2.00E-91 | 5.1.1.1 | 1083 | 360 | 1227 | 386 | |
| 167, 168 | Bacterial polypeptide #10001. | ADS60041 | 0.007 | 5.1.1.4 | 657 | 218 | 0 | 335 | 58 |
| 169, 170 | *Pseudomonas putida* racemase peptide, SEQ ID 5. | ADB99538 | 6.00E-11 | 5.1.1.1 | 1227 | 408 | 0 | 408 | 97 |
| 171, 172 | *Pseudomonas putida* racemase peptide, SEQ ID 5. | ADB99538 | 6.00E-11 | 5.1.1.1 | 1227 | 408 | 0 | 408 | 96 |
| 173, 174 | *Pseudomonas putida* racemase | ADB99538 | 6.00E-05 | 5.1.1.1 | 1224 | 407 | 0 | 408 | 95 |

TABLE 3-continued

| | | | | | | | | | |
|---|---|---|---|---|---|---|---|---|---|
| | peptide, SEQ ID 5. | | | | | | | | |
| 175, 176 | Pseudomonas putida racemase peptide, SEQ ID 5. | ADB99538 | 2.00E-14 | 5.1.1.1 | 1227 | 408 | 0 | 408 | 89 |
| 177, 178 | Pseudomonas putida racemase peptide, SEQ ID 5. | ADB99538 | 6.00E-11 | 5.1.1.1 | 1227 | 408 | 0 | 408 | 99 |
| 179, 180 | Pseudomonas putida racemase peptide, SEQ ID 5. | ADB99538 | 3.00E-10 | 5.1.1.1 | 1227 | 408 | 0 | 408 | 99 |
| 181, 182 | Pseudomonas putida racemase peptide, SEQ ID 5. | ADB99538 | 6.00E-11 | 5.1.1.1 | 1227 | 408 | 0 | 408 | 99 |
| 183, 184 | Pseudomonas putida racemase peptide, SEQ ID 5. | ADB99538 | 6.00E-11 | 5.1.1.1 | 1227 | 408 | 0 | 408 | 100 |
| 185, 186 | Pseudomonas putida racemase peptide, SEQ ID 5. | ADB99538 | 1.00E-15 | 5.1.1.1 | 1227 | 408 | 0 | 408 | 89 |
| 187, 188 | Pseudomonas putida racemase peptide, SEQ ID 5. | ADB99538 | 6.00E-11 | 5.1.1.1 | 1227 | 408 | 0 | 408 | 99 |
| 189, 190 | Pseudomonas putida racemase peptide, SEQ ID 5. | ADB99538 | 6.00E-11 | 5.1.1.1 | 1227 | 408 | 0 | 408 | 99 |
| 191, 192 | Pseudomonas putida racemase peptide, SEQ ID 5. | ADB99538 | 6.00E-11 | 5.1.1.1 | 1227 | 408 | 0 | 408 | 91 |
| 193, 194 | Pseudomonas putida racemase peptide, SEQ ID 5. | ADB99538 | 6.00E-11 | 5.1.1.1 | 1227 | 408 | 0 | 408 | 92 |
| 195, 196 | Pseudomonas putida racemase peptide, SEQ ID 5. | ADB99538 | 6.00E-11 | 5.1.1.1 | 1227 | 408 | 0 | 408 | 92 |
| 197, 198 | Pseudomonas putida racemase peptide, SEQ ID 5. | ADB99538 | 2.00E-14 | 5.1.1.1 | 1227 | 408 | 0 | 408 | 91 |
| 199, 200 | Pseudomonas putida racemase peptide, SEQ ID 5. | ADB99538 | 1.00E-15 | 5.1.1.1 | 1227 | 408 | 0 | 408 | 90 |

TABLE 3-continued

| | | | | | | | | | |
|---|---|---|---|---|---|---|---|---|---|
| 201, 202 | *Pseudomonas putida* racemase peptide, SEQ ID 5. | ADB99538 | 1.00E-15 | 5.1.1.1 | 1227 | 408 | 0 | 408 | 89 |
| 203, 204 | *Pseudomonas putida* racemase peptide, SEQ ID 5. | ADB99538 | 4.00E-18 | 5.1.1.1 | 1227 | 408 | 0 | 408 | 92 |
| 205, 206 | *Pseudomonas putida* racemase peptide, SEQ ID 5. | ADB99538 | 1.00E-15 | 5.1.1.1 | 1227 | 408 | 0 | 408 | 89 |
| 207, 208 | *Pseudomonas putida* racemase peptide, SEQ ID 5. | ADB99538 | 3.00E-16 | 5.1.1.1 | 1224 | 407 | 0 | 408 | 92 |
| 209, 210 | *Pseudomonas putida* racemase peptide, SEQ ID 5. | ADB99538 | 1.00E-12 | 5.1.1.1 | 1227 | 408 | 0 | 408 | 91 |
| 211, 212 | *Pseudomonas putida* racemase peptide, SEQ ID 5. | ADB99538 | 2.00E-14 | 5.1.1.1 | 1224 | 407 | 0 | 408 | 89 |
| 213, 214 | *Pseudomonas putida* racemase peptide, SEQ ID 5. | ADB99538 | 1.00E-15 | 5.1.1.1 | 1224 | 407 | 0 | 408 | 91 |
| 215, 216 | *Pseudomonas putida* racemase peptide, SEQ ID 5. | ADB99538 | 6.00E-11 | 5.1.1.1 | 1227 | 408 | 0 | 408 | 96 |
| 217, 218 | *Pseudomonas putida* racemase peptide, SEQ ID 5. | ADB99538 | 7.00E-14 | 5.1.1.1 | 1224 | 407 | 0 | 408 | 92 |
| 219, 220 | *Pseudomonas putida* racemase peptide, SEQ ID 5. | ADB99538 | 6.00E-11 | 5.1.1.1 | 1227 | 408 | 0 | 408 | 95 |
| 221, 222 | *Pseudomonas putida* racemase peptide, SEQ ID 5. | ADB99538 | 6.00E-11 | 5.1.1.1 | 1224 | 407 | 0 | 408 | 95 |
| 223, 224 | *Pseudomonas putida* racemase peptide, SEQ ID 5. | ADB99538 | 2.00E-14 | 5.1.1.1 | 1224 | 407 | 0 | 408 | 93 |
| 225, 226 | *Pseudomonas putida* racemase peptide, SEQ ID 5. | ADB99538 | 6.00E-11 | 5.1.1.1 | 1227 | 408 | 0 | 408 | 94 |

TABLE 3-continued

| | | | | | | | | | |
|---|---|---|---|---|---|---|---|---|---|
| 227, 228 | *Pseudomonas putida* racemase peptide, SEQ ID 5. | ADB99538 | 2.00E-14 | 5.1.1.1 | 1227 | 408 | 0 | 408 | 91 |
| 229, 230 | *Pseudomonas putida* racemase peptide, SEQ ID 5. | ADB99538 | 3.00E-13 | 5.1.1.1 | 1227 | 408 | 0 | 408 | 91 |
| 231, 232 | *Pseudomonas putida* racemase peptide, SEQ ID 5. | ADB99538 | 6.00E-11 | 5.1.1.1 | 1227 | 408 | 0 | 408 | 95 |
| 233, 234 | *Pseudomonas putida* racemase peptide, SEQ ID 5. | ADB99538 | 6.00E-11 | 5.1.1.1 | 1227 | 408 | 0 | 408 | 95 |
| 235, 236 | *Pseudomonas putida* racemase peptide, SEQ ID 5. | ADB99538 | 6.00E-05 | 5.1.1.1 | 1224 | 407 | 0 | 408 | 95 |
| 237, 238 | *Pseudomonas putida* racemase peptide, SEQ ID 5. | ADB99538 | 6.00E-05 | 5.1.1.1 | 1227 | 408 | 0 | 408 | 96 |
| 239, 240 | *Pseudomonas putida* racemase peptide, SEQ ID 5. | ADB99538 | 6.00E-11 | 5.1.1.1 | 1224 | 407 | 0 | 408 | 94 |
| 241, 242 | *Pseudomonas putida* racemase peptide, SEQ ID 5. | ADB99538 | 6.00E-11 | 5.1.1.1 | 1227 | 408 | 0 | 408 | 95 |
| 243, 244 | *Pseudomonas putida* racemase peptide, SEQ ID 5. | ADB99538 | 4.00E-06 | 5.1.1.1 | 1227 | 408 | 0 | 408 | 95 |
| 245, 246 | *Pseudomonas putida* racemase peptide, SEQ ID 5. | ADB99538 | 4.00E-06 | 5.1.1.1 | 1227 | 408 | 0 | 408 | 95 |
| 247, 248 | *Pseudomonas putida* racemase peptide, SEQ ID 5. | ADB99538 | 4.00E-06 | 5.1.1.1 | 1227 | 408 | 0 | 408 | 96 |
| 249, 250 | *Pseudomonas putida* racemase peptide, SEQ ID 5. | ADB99538 | 4.00E-06 | 5.1.1.1 | 1227 | 408 | 0 | 408 | 95 |
| 251, 252 | *Pseudomonas putida* racemase peptide, SEQ ID 5. | ADB99538 | 4.00E-06 | 5.1.1.1 | 1227 | 408 | 0 | 408 | 95 |

TABLE 3-continued

| | | | | | | | | | | |
|---|---|---|---|---|---|---|---|---|---|---|
| 253, 254 | *Pseudomonas putida* racemase peptide, SEQ ID 5. | ADB99538 | 4.00E-06 | 5.1.1.1 | 1224 | 407 | 0 | 408 | 95 | |
| 255, 256 | Plant polypeptide, SEQ ID 5546. | ADT17374 | 0.2 | 5.1.1.1 | 1086 | 361 | 1827 | 608 | 83 | 80 |
| 257, 258 | *Pseudomonas putida* racemase peptide, SEQ ID 5. | ADB99538 | 2.00E-08 | 5.1.1.1 | 1227 | 408 | 0 | 408 | 95 | |
| 259, 260 | *Pseudomonas putida* racemase peptide, SEQ ID 5. | ADB99538 | 6.00E-11 | 5.1.1.1 | 1227 | 408 | 0 | 408 | 95 | |
| 261, 262 | *Pseudomonas putida* racemase peptide, SEQ ID 5. | ADB99538 | 2.00E-08 | 5.1.1.1 | 1227 | 408 | 0 | 408 | 94 | |
| 263, 264 | *Pseudomonas putida* racemase peptide, SEQ ID 5. | ADB99538 | 6.00E-11 | 5.1.1.1 | 1227 | 408 | 0 | 408 | 95 | |
| 265, 266 | *Pseudomonas putida* racemase peptide, SEQ ID 5. | ADB99538 | 6.00E-11 | 5.1.1.1 | 1227 | 408 | 0 | 408 | 95 | |
| 267, 268 | *Pseudomonas putida* racemase peptide, SEQ ID 5. | ADB99538 | 6.00E-11 | 5.1.1.1 | 1227 | 408 | 0 | 408 | 94 | |
| 269, 270 | *Pseudomonas putida* racemase peptide, SEQ ID 5. | ADB99538 | 1.00E-12 | 5.1.1.1 | 1227 | 408 | 0 | 408 | 92 | |
| 271, 272 | *Pseudomonas putida* racemase peptide, SEQ ID 5. | ADB99538 | 3.00E-13 | 5.1.1.1 | 1230 | 409 | 0 | 408 | 92 | |
| 273, 274 | *Pseudomonas putida* racemase peptide, SEQ ID 5. | ADB99538 | 6.00E-11 | 5.1.1.1 | 1227 | 408 | 0 | 408 | 96 | |
| 275, 276 | *Pseudomonas putida* racemase peptide, SEQ ID 5. | ADB99538 | 6.00E-11 | 5.1.1.1 | 1227 | 408 | 0 | 408 | 97 | |
| 277, 278 | *Pseudomonas putida* racemase peptide, SEQ ID 5. | ADB99538 | 2.00E-14 | 5.1.1.1 | 1227 | 408 | 0 | 408 | 92 | |

TABLE 3-continued

| | | | | | | | | | |
|---|---|---|---|---|---|---|---|---|---|
| 279, 280 | Pseudomonas putida racemase peptide, SEQ ID 5. | ADB99538 | 1.00E-15 | 5.1.1.1 | 1227 | 408 | 0 | 408 | 92 |
| 281, 282 | Pseudomonas putida racemase peptide, SEQ ID 5. | ADB99538 | 1.00E-18 | 5.1.1.1 | 1227 | 408 | 0 | 408 | 92 |
| 283, 284 | Pseudomonas putida racemase peptide, SEQ ID 5. | ADB99538 | 1.00E-18 | 5.1.1.1 | 1227 | 408 | 0 | 408 | 92 |
| 285, 286 | Pseudomonas putida racemase peptide, SEQ ID 5. | ADB99538 | 6.00E-11 | 5.1.1.1 | 1227 | 408 | 0 | 408 | 95 |
| 287, 288 | Pseudomonas putida racemase peptide, SEQ ID 5. | ADB99538 | 6.00E-11 | 5.1.1.1 | 1227 | 408 | 0 | 408 | 95 |
| 289, 290 | Pseudomonas putida racemase peptide, SEQ ID 5. | ADB99538 | 6.00E-11 | 5.1.1.1 | 1227 | 408 | 0 | 408 | 95 |
| 291, 292 | Pseudomonas putida racemase peptide, SEQ ID 5. | ADB99538 | 2.00E-14 | 5.1.1.1 | 1227 | 408 | 0 | 408 | 92 |
| 293, 294 | Pseudomonas putida racemase peptide, SEQ ID 5. | ADB99538 | 6.00E-11 | 5.1.1.1 | 1227 | 408 | 0 | 408 | 94 |
| 295, 296 | Pseudomonas putida racemase peptide, SEQ ID 5. | ADB99538 | 4.00E-06 | 5.1.1.1 | 1227 | 408 | 0 | 408 | 95 |
| 297, 298 | Prokaryotic essential gene #34740. | ACA19650 | 9.00E-22 | 5.1.1.4 | 960 | 319 | 945 | 331 | |
| 299, 300 | Pseudomonas putida racemase peptide, SEQ ID 5. | ADB99538 | 5.00E-95 | 5.1.1.1 | 1230 | 409 | 0 | 409 | 73 |
| 301, 302 | Pseudomonas putida racemase peptide, SEQ ID 5. | ADB99538 | 5.00E-27 | 5.1.1.1 | 1239 | 412 | 1227 | 409 | |
| 303, 304 | Prokaryotic essential gene #34740. | ACA44058 | 7.00E-14 | 5.1.1.4 | 375 | 124 | 0 | 314 | 60 |

TABLE 3-continued

| | | | | | | | | | | |
|---|---|---|---|---|---|---|---|---|---|---|
| 305, 306 | Prokaryotic essential gene #34740. | ACA27267 | 0.21 | 5.1.1.1 | 1125 | 374 | 1167 | 388 | 64 | 66 |
| 307, 308 | Bacterial polypeptide #10001. | ADS60041 | 2.00E-05 | 5.1.1.4 | 429 | 142 | 0 | 333 | 73 | |
| 309, 310 | Prokaryotic essential gene #34740. | ACA43665 | 3.00E-13 | 5.1.1.1 | 408 | 135 | 0 | 355 | 80 | |
| 311, 312 | Novel mar regulated protein (NIMR) #29. | AAS46252 | 0.67 | 5.1.2.2 | 939 | 312 | 0 | 321 | 81 | |
| 313, 314 | *C. botulinum* active BoNT/A modified open reading frame, SEQ ID No: 7. | AEF99607 | 0.65 | 5.1.1.4 | 909 | 302 | 1002 | 333 | 70 | 62 |
| 315, 316 | *Haemophilus influenzae* (NTHi) protein - SEQ ID 618. | ADT05504 | 0.03 | 5.1.1.4 | 684 | 227 | 0 | 335 | 79 | |
| 317, 318 | Prokaryotic essential gene #34740. | ACA23465 | 2.9 | 5.5.1.1 | 1032 | 343 | 0 | 348 | 57 | |
| 319, 320 | *Pseudomonas aeruginosa* polypeptide #3. | ABD15666 | 3.00E-05 | 5.1.1.4 | 636 | 211 | 486 | 339 | | |
| 321, 322 | Breast cancer related marker, seq id 2. | ACN89360 | 0.49 | 5.1.1.13 | 699 | 232 | 687 | 228 | 31 | 46 |
| 323, 324 | Bacterial polypeptide #10001. | ADS60041 | 0.16 | 5.1.1.4 | 885 | 294 | 0 | 336 | 85 | |
| 325, 326 | Bacterial polypeptide #10001. | ADS60041 | 5.00E-08 | 5.1.1.4 | 1005 | 334 | 0 | 333 | 73 | |
| 327, 328 | Bacterial polypeptide #10001. | ADS60041 | 0.012 | 5.1.1.4 | 1002 | 333 | 0 | 333 | 74 | |
| 329, 330 | Prokaryotic essential gene #34740. | ACA23259 | 1.00E-17 | 5.1.1.4 | 957 | 318 | 0 | 311 | 58 | |
| 331, 332 | *Mycobacterium tuberculosis* strain H37Rv genome SEQ ID NO 2. | AAI99682 | 1.1 | 5.1.1.1 | 420 | 139 | 1167 | 388 | 61 | 68 |

TABLE 3-continued

| | | | | | | | | | |
|---|---|---|---|---|---|---|---|---|---|
| 333, 334 | Plant full length insert polynucleotide seqid 4980. | ADX51636 | 0.67 | 5.1.1.1 | 939 | 312 | 0 | 377 | 58 |
| 335, 336 | *Enterobacter cloacae* protein amino acid sequence - SEQ ID 5666. | AEH54260 | 0.053 | 5.1.1.1 | 1143 | 380 | 0 | 373 | 41 |
| 337, 338 | *Bacillus licheniformis* araA gene fragment amplifying PCR primer #1. | AAD29866 | 8.00E-04 | 5.1.1.1 | 1107 | 368 | 0 | 373 | 44 |
| 339, 340 | Prokaryotic essential gene #34740. | ACA23293 | 5.00E-05 | 5.1.1.1 | 1068 | 355 | 0 | 418 | 60 |
| 341, 342 | Geranylgeranyl pyrophosphate synthase polypeptide #7. | ADM98687 | 0.046 | 5.5.1.1 | 990 | 329 | 0 | 335 | 57 |
| 343, 344 | *Streptomyces cattleya* NRRL 8057 orfY protein. | ADO51695 | 0.83 | 5.1.1.1 | 1134 | 377 | 0 | 377 | 62 |
| 345, 346 | Prokaryotic essential gene #34740. | ACA25617 | 2.2 | 5.1.1.1 | 777 | 258 | 1167 | 388 | 57 | 65 |
| 347, 348 | Plant full length insert polynucleotide seqid 4980. | ADX51636 | 0.81 | 5.1.1.1 | 1113 | 370 | 0 | 377 | 58 |
| 349, 350 | Prokaryotic essential gene #34740. | ACA42641 | 0.72 | 5.1.2.2 | 993 | 330 | 0 | 326 | 51 |
| 351, 352 | *Klebsiella pneumoniae* polypeptide seqid 7178. | ACH94858 | 5.00E-05 | 5.5.1.1 | 1005 | 334 | 0 | 354 | 52 |
| 353, 354 | Prokaryotic essential gene #34740. | ACA19650 | 3.00E-22 | 5.1.1.4 | 381 | 126 | 945 | 318 | | |
| 355, 356, | Prokaryotic essential gene #34740. | ACA38093 | 9.00E-04 | 5.1.1.1 | 1155 | 384 | 0 | 360 | 39 |
| 357, 358 | Prokaryotic essential gene #34740. | ACA40224 | 0.88 | 5.1.1.1 | 1203 | 400 | 0 | 849 | 52 |

TABLE 3-continued

| | | | | | | | | |
|---|---|---|---|---|---|---|---|---|
| 359, 360 | T. versicolor pyrF PCR primer SEQ ID 5. | AAF26441 | 0.88 | 5.1.1.1 | 1203 | 400 | 0 | 849 | 52 |
| 361, 362 | T. versicolor pyrF PCR primer SEQ ID 5. | AAF26441 | 0.88 | 5.1.1.1 | 1203 | 400 | 0 | 849 | 52 |
| 363, 364 | T. versicolor pyrF PCR primer SEQ ID 5. | AAF26441 | 0.88 | 5.1.1.1 | 1203 | 400 | 0 | 849 | 52 |
| 365, 366 | T. versicolor pyrF PCR primer SEQ ID 5. | AAF26441 | 0.88 | 5.1.1.1 | 1203 | 400 | 0 | 849 | 52 |
| 367, 368 | Prokaryotic essential gene #34740. | ACA43665 | 7.00E-32 | 5.1.1.1 | 1074 | 357 | 0 | 362 | 82 |
| 369, 370 | S. lavendulae mct gene mutagenic PCR primer #2. | ADE10236 | 0.16 | 5.1.1.7 | 861 | 286 | 1413 | 285 | |
| 371, 372 | Bacterial polypeptide #10001. | ADT46187 | 2.00E-06 | 5.1.1.7 | 813 | 270 | 0 | 277 | 57 |
| 373, 374 | Enviromental isolate hydrolase, SEQ ID NO: 44. | AEH47413 | 0.16 | 5.1.1.7 | 873 | 290 | 900 | 285 | |
| 375, 376 | Bacterial polypeptide #10001. | ADT42245 | 9.2 | 5.1.1.7 | 828 | 275 | 0 | 280 | 29 |
| 377, 378 | Prokaryotic essential gene #34740. | ACA27041 | 6.00E-08 | 5.1.3.14 | 1200 | 399 | 0 | 386 | 50 |
| 379, 380 | Bacterial polypeptide #10001. | ADS59825 | 3.00E-06 | 1.6.5.3 | 879 | 292 | 0 | 287 | 55 |
| 381, 382 | Bacterial polypeptide #10001. | ADS59825 | 1.00E-08 | 1.6.5.3 | 879 | 292 | 0 | 289 | 55 |
| 383, 384 | Novel canine microarray-related DNA sequence SeqID10021. | ADQ53782 | 3.1 | 5.1.2.2 | 1071 | 356 | 0 | 356 | 50 |

TABLE 3-continued

| SEQ_ID NO. | NR Description | NR Accession Code | NR Evalue | NR Organism | Geneseq Protein Description | Geneseq Protein Accession Code | Geneseq Protein Evalue | Geneseq DNA Description | Geneseq DNA Accession Code |
|---|---|---|---|---|---|---|---|---|---|
| 1, 2 | hypothetical protein [*Aquifex aeolicus*]. | 15605814 | 1.00E-128 | *Aquifex aeolicus* | Prokaryotic essential gene #34740. | ABU25646 | 3.00E-47 | *Drosophila melanogaster* polypeptide SEQ ID NO 124465. | ABL03829 |

| SEQ_ID NO. | Geneseq DNA Evalue | Predicted EC Number | Query DNA Length | Query Protein Length | Geneseq/NR DNA Length | Geneseq/NR Protein Length | Geneseq/NR % ID Protein | Geneseq/NR % ID DNA |
|---|---|---|---|---|---|---|---|---|
| 1, 2 | 0.48 | 2.7.3. | 687 | 228 | 687 | 228 | 100 | 100 |

| SEQ ID NO: | NR Description | NR Accession Code | NR Evalue | Organism | Geneseq Protein Description | Geneseq Protein Accession Code | Evalue |
|---|---|---|---|---|---|---|---|
| 3, 4 | alanine racemase [*Aquifex aeolicus*]. | 15606873 | 0 | *Aquifex aeolicus* | *Aquifex pyrophilus* heat resistant alanine racemase encoding DNA. | ABB0629 | 6 1.00E-147 |
| 5, 6 | hypothetical protein SAV6126 [*Streptomyces avermitilis* MA-4680] | 29832668 | 1.00E-101 | *Streptomyces avermitilis* MA-4680 | Prokaryotic essential gene #34740. | ABU19499 | 5.00E-37 |
| 7, 8 | hypothetical protein SAV4292 [*Streptomyces avermitilis* MA-4680] | 29830835 | 0 | *Streptomyces avermitilis* MA-4680 | *Propionibacterium acnes* predicted ORF-encoded polypeptide #300 | ABM54358 | 2.00E-53 |
| 9, 10 | alanine racemase [*Streptomyces coelicolor* A3(2)] | 21223124 | 1.00E-166 | *Streptomyces coelicolor* A3(2) | Prokaryotic essential gene #34740. | ABU34223 | 6.00E-90 |
| 11, 12 | alanine racemase [*Rhodopseudomonas palustris* HaA2] | 86748627 | 1.00E-106 | *Rhodopseudomonas palustris* HaA2 | *Pseudomonas aeruginosa* polypeptide #3. | ABO84274 | 4.00E-50 |
| 13, 14 | alanine racemase [*Azoarcus* sp. EbN1] | 56477426 | 1.00E-128 | *Azoarcus* sp. EbN1 | Prokaryotic essential gene #34740. | ABU41398 | 1.00E-110 |
| 15, 16 | Aspartate racemase [*Marinobacter algicola* DG893] | 1.49E+08 | 4.00E-93 | *Marinobacter algicola* DG893 | *Klebsiella pneumoniae* polypeptide seqid 7178. | ABO65503 | 1.00E-71 |
| 17, 18 | glutamate racemase [*Cytophaga hutchinsonii* ATCC 33406] | 1.11E+08 | 1.00E-106 | *Cytophaga hutchinsonii* ATCC 33406 | Prokaryotic essential gene #34740. | ABU25174 | 2.00E-44 |
| 19, 20 | glutamate racemase [*Geobacter sulfurreducens* PCA] | 39998014 | 1.00E-74 | *Geobacter sulfurreducens* PCA | *M. xanthus* protein sequence, seq id 9726. | ABM90755 | 2.00E-67 |

TABLE 3-continued

| | | | | | | |
|---|---|---|---|---|---|---|
| 21, 22 | Putative decarboxylase [*Bordetella parapertussis* 12822] | 33596748 | 5.00E-40 | *Bordetella parapertussis* 12822 | *Thermococcus kodakaraensis* KOD1 protein sequence SeqID4. | ADN46910 5.00E-27 |
| 23, 24 | alanine racemase [*Enterobacter* sp. 638] | 1.46E+08 | 0 | *Enterobacter* sp. 638 | *Enterobacter cloacae* protein amino acid sequence - SEQ ID 5666. | AEH63094 0 |
| 25, 26 | alanine racemase [*Enterobacter* sp. 638] | 1.46E+08 | 0 | *Enterobacter* sp. 638 | *Enterobacter cloacae* protein amino acid sequence - SEQ ID 5666. | AEH63094 0 |
| 27, 28 | hypothetical protein SAR11_0361 [*Candidatus Pelagibacter ubique* HTCC1062] | 71083067 | 1.00E-121 | *Candidatus Pelagibacter ubique* HTCC1062 | Prokaryotic essential gene #34740. | ABU24290 2.00E-31 |
| 29, 30 | putative proline racemase [*Brucella ovis* ATCC 25840] | 1.49E+08 | 1.00E-130 | *Brucella ovis* ATCC 25840 | *Pseudomonas aeruginosa* polypeptide #3. | ABO82134 1.00E-127 |
| 31, 32 | proline racemase, putative [*Stappia aggregata* IAM 12614] gi\|118435940\|gb\|EAV42584.1\| proline racemase, putative [*Stappia aggregata* IAM 12614] | 1.19E+08 | 1.00E-109 | *Stappia aggregata* IAM 12614 | *Acinetobacter baumannii* protein #19. | ADA35228 1.00E-105 |
| 33, 34 | alanine racemase [*Mesorhizobium* sp. BNC1] | 1.11E+08 | 1.00E-124 | *Mesorhizobium* sp. BNC1 | Prokaryotic essential gene #34740. | ABU38829 3.00E-46 |
| 35, 36 | putative alanine racemase [*Aurantimonas* sp. SI85-9A1] gi\|90338111\|gb\|EAS51762.1\| putative alanine racemase [*Aurantimonas* sp. S185-9A1] | 90418439 | 6.00E-49 | *Aurantimonas* sp. SI85-9A1 | *Achromobacter xylosoxidans* DTA SEQ ID NO 6. | AEH19277 5.00E-47 |
| 37, 38 | Alanine racemase [*Magnetospirillum gryphiswaldense* MSR-1] | 1.45E+08 | 1.00E-38 | *Magnetospirillum gryphiswaldense* MSR-1 | *Aquifex pyrophilus* heat resistant alanine racemase encoding DNA. | ABB06296 2.00E-20 |
| 39, 40 | putative proline racemase [*Burkholderia* LB400] | 91779222 | 2.00E-36 | *Burkholderia xenovorans* LB400 | Prokaryotic essential gene #34740. | ABU21813 5.00E-37 |
| 41, 42 | alanine racemase [*Pseudomonas putida* F1] | 1.49E+08 | 0 | *Pseudomonas putida* F1 | *T. maritima* D-alanine-D-alanine-ligase. | AED11803 0 |

TABLE 3-continued

| | | | | | |
|---|---|---|---|---|---|
| 43, 44 | alanine racemase [*Pseudomonas putida* F1] | 1.49E+08 0 | *Pseudomonas putida* F1 | *T. maritima* D-alanine D-alanine ligase. | AED11803 0 |
| 45, 46 | alanine racemase [*Pseudomonas putida* F1] | 1.49E+08 0 | *Pseudomonas putida* F1 | *T. maritima* D-alanine D-alanine ligase. | AED11803 0 |
| 47, 48 | alanine racemase [*Pseudomonas putida* F1] | 1.49E+08 0 | *Pseudomonas putida* F1 | *T. maritima* D-alanine- D-alanine ligase. | AED11803 0 |
| 49, 50 | alanine racemase [*Pseudomonas putida* F1] | 1.49E+08 0 | *Pseudomonas putida* F1 | *T. maritima* D-alanine- D-alanine ligase. | AED11803 0 |
| 51, 52 | alanine racemase [*Pseudomonas putida* GB-1] gi\|126314851\|gb\|EAZ66019.1\| alanine racemase [*Pseudomonas putida* GB-1] | 1.26E+08 0 | *Pseudomonas putida* GB-1 | *T. maritima* D-alanine- D-alanine ligase. | AED11803 1.00E-180 |
| 53, 54 | alanine racemase [*Pseudomonas putida* GB-1] gi\|126314851\|gb\|EAZ66019.1\| alanine racemase [*Pseudomonas putida* GB-1] | 1.26E+08 1.00E-180 | *Pseudomonas putida* GB-1 | *T. maritima* D-alanine- D-alanine ligase. | AED11803 1.00E-180 |
| 55, 56 | alanine racemase [*Pseudomonas putida* GB-1] gi\|126314851\|gb\|EAZ66019.1\| alanine racemase [*Pseudomonas putida* GB-1] | 1.26E+08 1.00E-180 | *Pseudomonas putida* GB-1 | *T. maritima* D-alanine- D-alanine ligase. | AED11803 1.00E-179 |
| 57, 58 | alanine racemase [*Pseudomonas putida* F1] | 1.49E+08 0 | *Pseudomonas putida* F1 | *T. maritima* D-alanine- D-alanine ligase. | AED11804 0 |
| 59, 60 | alanine racemase [*Pseudomonas putida* F1] | 1.49E+08 0 | *Pseudomonas putida* F1 | *T. maritima* D-alanine- D-alanine ligase. | AED11804 0 |
| 61, 62 | alanine racemase [*Fusobacterium nucleatum* subsp. *polymorphum* ATCC 10953] | 1.48E+08 7.00E-19 | *Fusobacterium nucleatum* subsp. *polymorphum* ATCC 10953 | *Aquifex pyrophilus* heat resistant alanine racemase encoding DNA. | ABB06296 1.00E-12 |
| 63, 64 | alanine racemase [*Pseudomonas putida* F1] | 1.49E+08 0 | *Pseudomonas putida* F1 | *T. maritima* D-alanine- D-alanine ligase. | AED11803 0 |
| 65, 66 | alanine racemase [*Pseudomonas putida* F1] | 1.49E+08 0 | *Pseudomonas putida* F1 | *T. maritima* D-alanine- D-alanine ligase. | AED11803 0 |
| 67, 68 | alanine racemase [*Pseudomonas putida* GB-1] gi\|126314851\|gb\|EAZ66019.1\| alanine racemase [*Pseudomonas putida* GB-1] | 1.26E+08 0 | *Pseudomonas putida* GB-1 | *T. maritima* D-alanine- D-alanine ligase. | AED11803 0 |

TABLE 3-continued

| | | | | | |
|---|---|---|---|---|---|
| 69, 70 | alanine racemase [*Pseudomonas putida* GB-1] gi\|126314851\|gb\|EAZ66019.1\| alanine racemase [*Pseudomonas putida* GB-1] | 1.26E+080 | *Pseudomonas putida* GB-1 | *T. maritima* D-alanine-D-alanine ligase. | AED11803 0 |
| 71, 72 | alanine racemase [*Pseudomonas putida* GB-1] gi\|126314851\|gb\|EAZ66019.1\| alanine racemase [*Pseudomonas putida* GB-1] | 1.26E+080 | *Pseudomonas putida* GB-1 | *T. maritima* D-alanine-D-alanine ligase | AED11803 0 |
| 73, 74 | alanine racemase [*Pseudomonas putida* GB-1] gi\|126314851\|gb\|EAZ66019.1\| alanine racemase [*Pseudomonas putida* GB-1] | 1.26E+080 | *Pseudomonas putida* GB-1 | *T. maritima* D-alanine-D-alanine ligase | AED11803 0 |
| 75, 76 | alanine racemase [*Pseudomonas putida* GB-1] gi\|126314851\|gb\|EAZ66019.1\| alanine racemase [*Pseudomonas putida* GB-1] | 1.26E+080 | *Pseudomonas putida* GB-1 | *T. maritima* D-alanine-D-alanine ligase. | AED11803 0 |
| 77, 78 | alanine racemase [*Pseudomonas putida* F1] | 1.49E+080 | *Pseudomonas putida* F1 | *T. maritima* D-alanine-D-alanine ligase. | AED11803 0 |
| 79, 80 | alanine racemase [*Pseudomonas putida* F1] | 1.49E+080 | *Pseudomonas putida* F1 | *T. maritima* D-alanine-D-alanine ligase. | AED11804 0 |
| 81, 82 | alanine racemase [*Pseudomonas putida* F1] | 1.49E+080 | *Pseudomonas putida* F1 | *T. maritima* D-alanine-D-alanine ligase. | AED11804 0 |
| 83, 84 | alanine racemase [*Pseudomonas putida* F1] | 1.49E+080 | *Pseudomonas putida* F1 | *T. maritima* D-alanine-D-alanine ligase. | AED11804 0 |
| 85, 86 | alanine racemase [*Pseudomonas putida* F1] | 1.49E+080 | *Pseudomonas putida* F1 | *T. maritima* D-alanine-D-alanine ligase. | AED11803 0 |
| 87, 88 | alanine racemase [*Pseudomonas putida* F1] | 1.49E+080 | *Pseudomonas putida* F1 | *T. maritima* D-alanine-D-alanine ligase. | AED11803 0 |
| 89, 90 | alanine racemase [*Pseudomonas putida* KT2440] | 269904300 | *Pseudomonas putida* KT2440 | *T. maritima* D-alanine-D-alanine ligase. | AED11803 0 |
| 91, 92 | alanine racemase [*Pseudomonas putida* F1] | 1.49E+080 | *Pseudomonas putida* F1 | *T. maritima* D-alanine-D-alanine ligase. | AED11803 0 |
| 93, 94 | alanine racemase [*Pseudomonas putida* F1] | 1.49E+080 | *Pseudomonas putida* F1 | *T. maritima* D-alanine-D-alanine ligase. | AED11804 0 |

TABLE 3-continued

| SEQ IDs | Name | Value | Source | Homolog | Accession |
|---|---|---|---|---|---|
| 95, 96 | alanine racemase [*Pseudomonas putida* GB-1] gi\|126314851\|gb\|EAZ66019.1\| alanine racemase [*Pseudomonas putida* GB-1] | 1.26E+08 0 | *Pseudomonas putida* GB-1 | *T. maritima* D-alanine-D-alanine ligase. | AED11803 0 |
| 97, 98 | alanine racemase [*Pseudomonas putida* GB-1] gi\|126314851\|gb\|EAZ66019.1\| alanine racemase [*Pseudomonas putida* GB-1] | 1.26E+08 0 | *Pseudomonas putida* GB-1 | *T. maritima* D-alanine-D-alanine ligase. | AED11803 0 |
| 99, 100 | alanine racemase [*Pseudomonas putida* F1] | 1.49E+08 0 | *Pseudomonas putida* F1 | *T. maritima* D-alanine-D-alanine ligase. | AED11803 0 |
| 101, 102 | alanine racemase 2, catabolic [*Escherichia coli* O157:H7 EDL933]. | 15801412 2.00E-58 | *Escherichia coli* O157:H7 EDL933 | Prokaryotic essential gene #34740. | ABU45089 2.00E-58 |
| 103, 104 | aspartate racemase [*Pyrococcus abyssi*]. | 14521575 8.00E-29 | *Pyrococcus abyssi* | *Thermococcus kodakaraensis* KOD1 protein sequence SEQ ID 4. | ADN46207 2.00E-25 |
| 105, 106 | proline racemase [*Microscilla marina* ATCC 23134] gi\|123984081\|gb\|EAY24454.1\| proline racemase [*Microscilla marina* ATCC 23134] | 1.24E+08 1.00E-150 | *Microscilla marina* ATCC 23134 | Bacterial polypeptide #100001. | ADS22995 1.00E-128 |
| 107, 108 | alanine recemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED10581 1.00E-131 |
| 109, 110 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3 | AED10581 1.00E-129 |
| 111, 112 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED10581 1.00E-131 |
| 113, 114 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED10581 1.00E-131 |

TABLE 3-continued

| SEQ IDs | Description | E-value 1 | E-value 2 | Organism | Function | Accession |
|---|---|---|---|---|---|---|
| 115, 116 | alanine racemase [Aeromonas hydrophila subsp. hydrophila ATCC 7966] | 1.18E+08 | 0 | Aeromonas hydrophila subsp. hydrophila ATCC 7966 | Empedobacter brevis mature peptide synthesizing enzyme SEQ ID NO: 3. | AED10581 1.00E-132 |
| 117, 118 | alanine racemase [Aeromonas hydrophila subsp. hydrophila ATCC 7966] | 1.18E+08 | 0 | Aeromonas hydrophila subsp. hydrophila ATCC 7966 | Empedobacter brevis mature peptide synthesizing enzyme SEQ ID NO: 3. | AED10581 1.00E-131 |
| 119, 120 | alanine racemase [Aeromonas hydrophila subsp. hydrophila ATCC 7966] | 1.18E+08 | 0 | Aeromonas hydrophila subsp. hydrophila ATCC 7966 | Empedobacter brevis mature peptide synthesizing enzyme SEQ ID NO: 3. | AED10581 1.00E-130 |
| 121, 122 | alanine racemase [Pseudomonas putida F1] | 1.49E+08 | 1.00E-136 | Pseudomonas putida F1 | T. maritima D-alanine-D-alanine ligase. | AED11803 1.00E-137 |
| 123, 124 | alanine racemase [Aeromonas hydrophila subsp. hydrophila ATCC 7966] | 1.18E+08 | 0 | Aeromonas hydrophila subsp. hydrophila ATCC 7966 | Empedobacter brevis mature peptide synthesizing enzyme SEQ ID NO: 3. | AED10581 1.00E-127 |
| 125, 126 | alanine racemase [Pseudomonas putida GB-1] gi\|126314851\|gb\|EAZ66019.1\| alanine racemase [Pseudomonas putida GB-1] | 1.26E+08 | 1.00E-155 | Pseudomonas putida GB-1 | Empedobacter brevis mature peptide synthesizing enzyme SEQ ID NO: 3. | AED10581 1.00E-159 |
| 127, 128 | glutamate racemase [Bradyrhizobium japonicum USDA 110] | 27380813 | 3.00E-26 | Bradyrhizobium japonicum USDA 110 | Photorhabdus luminescens protein sequence #59. | ABM68637 7.00E-18 |
| 129, 130 | proline racemase, putative [Stappia aggregata IAM 12614] gi\|118435940\|gb\|EAV42584.1\| proline racemase, putative [Stappia aggregate IAM 12614] | 1.19E+08 | 1.00E-103 | Stappia aggregate IAM 12614 | Prokaryotic essential gene #34740. | ABU21813 1.00E-101 |
| 131, 132 | putative proline racemase [Myxococcus xanthus DK 1622] | 1.09E+08 | 5.00E-75 | Myxococcus xanthus DK 1622 | M. xanthus protein sequence, seq id 9726. | ABM96637 1.00E-75 |
| 133, 134 | alanine racemase [Aeromonas hydrophila subsp. hydrophila ATCC 7966] | 1.18E+08 | 0 | Aeromonas hydrophila subsp. hydrophila ATCC | Empedobacter brevis mature peptide synthesizing | AED10581 1.00E-130 |

TABLE 3-continued

| | | | | | |
|---|---|---|---|---|---|
| | | | 7966 | enzyme SEQ ID NO: 3. | |
| 135, 136 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-129 |
| 137, 138 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-128 |
| 139, 140 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 141, 142 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-130 |
| 143, 144 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 145, 146 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 147, 148 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 149, 150 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 151, 152 | alanine racemase [Aeromonas hydrophila subsp. hydrophila ATCC | 1.18E+080 | Aeromonas hydrophila subsp. hydrophila | Empedobacter brevis mature peptide | AED105811.00E-131 |

TABLE 3-continued

| | | | | | |
|---|---|---|---|---|---|
| 7966] | | | ATCC 7966 | synthesizing enzyme SEQ ID NO: 3. | |
| 153, 154 | alanine racemase [Aeromonas hydrophila subsp. hydrophila ATCC 7966] | 1.18E+08 0 | Aeromonas hydrophila subsp. hydrophila ATCC 7966 | Empedobacter brevis mature peptide synthesizing enzyme SEQ ID NO: 3. | AED10581 1.00E-131 |
| 155, 156 | alanine racemase [Aeromonas hydrophila subsp. hydrophila ATCC 7966] | 1.18E+08 0 | Aeromonas hydrophila subsp. hydrophila ATCC 7966 | Empedobacter brevis mature peptide synthesizing enzyme SEQ ID NO: 3. | AED10581 1.00E-133 |
| 157, 158 | alanine racemase [Aeromonas hydrophila subsp. hydrophila ATCC 7966] | 1.18E+08 0 | Aeromonas hydrophila subsp. hydrophila ATCC 7966 | Empedobacter brevis mature peptide synthesizing enzyme SEQ ID NO: 3. | AED10581 1.00E-132 |
| 159, 160 | alanine racemase [Aeromonas hydrophila subsp. hydrophila ATCC 7966] | 1.18E+08 0 | Aeromonas hydrophila subsp. hydrophila ATCC 7966 | Empedobacter brevis mature peptide synthesizing enzyme SEQ ID NO: 3. | AED10581 1.00E-131 |
| 161, 162 | alanine racemase [Aeromonas hydrophila subsp. hydrophila ATCC 7966] | 1.18E+08 0 | Aeromonas hydrophila subsp. hydrophila ATCC 7966 | Empedobacter brevis mature peptide synthesizing enzyme SEQ ID NO: 3. | AED10581 1.00E-131 |
| 163, 164 | alanine racemase [Pseudomonas putida F1] | 1.49E+08 1.00E-153 | Pseudomonas putida F1 | Empedobacter brevis mature peptide synthesizing enzyme SEQ ID NO: 3. | AED10581 0 |
| 165, 166 | alanine racemase [Pseudomonas putida F1] | 1.49E+08 1.00E-153 | Pseudomonas putida F1 | Empedobacter brevis mature peptide synthesizing enzyme SEQ ID NO: 3. | AED10581 0 |
| 167, 168 | proline racemase [Flavobacteriales bacterium HTCC2170] gi\|88708932\|gb\|EAR01166.1\| proline racemase [Flavobacteriales bacterium HTCC2170] | 88712394 1.00E-69 | Flavobacteriales bacterium HTCC2170 | Bacterial polypeptide #10001. | ADS22995 2.00E-57 |

TABLE 3-continued

| | | | | | |
|---|---|---|---|---|---|
| 169, 170 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 171, 172 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 173, 174 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-129 |
| 175, 176 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-130 |
| 177, 178 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 179, 180 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 181, 182 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-130 |
| 183, 184 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 185, 186 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing | AED105811.00E-129 |

TABLE 3-continued

| | | | | | |
|---|---|---|---|---|---|
| | | | 7966 | enzyme SEQ ID NO: 3. | |
| 187, 188 | alanine racemase [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-131 |
| 189, 190 | alanine racemase [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-131 |
| 191, 192 | alanine racemase [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-131 |
| 193, 194 | alanine racemase [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-131 |
| 195, 196 | alanine racemase [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-131 |
| 197, 198 | alanine racemase [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-131 |
| 199, 200 | alanine racemase [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-130 |
| 201, 202 | alanine racemase [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-129 |
| 203, 204 | alanine racemase [*Aeromonas hydrophila* subsp. *hydrophila* ATCC | 1.18E+080 | *Aeromonas hydrophila* subsp. *hydrophila* | *Empedobacter brevis* mature peptide | AED105811.00E-130 |

TABLE 3-continued

| | | | | | |
|---|---|---|---|---|---|
| 7966] | | | ATCC 7966 | synthesizing enzyme SEQ ID NO: 3. | |
| 205, 206 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-130 |
| 207, 208 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-133 |
| 209, 210 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 211, 212 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-131 |
| 213, 214 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-133 |
| 215, 216 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-130 |
| 217, 218 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 219, 220 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-129 |
| 221, 222 | alanine racemase [Aeromonas salmonicida subsp. | 1.45E+080 | Aeromonas salmonicida subsp. | Empedobacter brevis mature | AED105811.00E-128 |

TABLE 3-continued

| | | | | |
|---|---|---|---|---|
| subsp. salmonicida A449] | | salmonicida A449 | peptide synthesizing enzyme SEQ ID NO: 3. | |
| 223, 224 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-133 |
| 225, 226 alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-130 |
| 227, 228 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 229, 230 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-130 |
| 231, 232 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-130 |
| 233, 234 alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-128 |
| 235, 236 alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-128 |
| 237, 238 alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-128 |

TABLE 3-continued

| | | | | | |
|---|---|---|---|---|---|
| 239, 240 | alanine racemase [*Aeromonas salmonicida* subsp. *salmonicida* A449] | 1.45E+08 | 0 | *Aeromonas salmonicida* subsp. *salmonicida* A449 | *Empedobacter brevis* mature peptide synthesizing enzyme SEQ ID NO: 3. | AED10581 1.00E-128 |
| 241, 242 | alanine racemase [*Aeromonas salmonicida* subsp. *salmonicida* A449] | 1.45E+08 | 0 | *Aeromonas salmonicida* subsp. *salmonicida* A449 | *Empedobacter brevis* mature peptide synthesizing enzyme SEQ ID NO: 3. | AED10581 1.00E-130 |
| 243, 244 | alanine racemase [*Aeromonas hydrophila* subsp. *hydrophila* ATCC 7966] | 1.18E+08 | 0 | *Aeromonas hydrophila* subsp. *hydrophila* ATCC 7966 | *Empedobacter brevis* mature peptide synthesizing enzyme SEQ ID NO: 3. | AED10581 1.00E-129 |
| 245, 246 | alanine racemase [*Aeromonas hydrophila* subsp. *hydrophila* ATCC 7966] | 1.18E+08 | 0 | *Aeromonas hydrophila* subsp. *hydrophila* ATCC 7966 | *Empedobacter brevis* mature peptide synthesizing enzyme SEQ ID NO: 3. | AED10581 1.00E-129 |
| 247, 248 | alanine racemase [*Aeromonas hydrophila* subsp. *hydrophila* ATCC 7966] | 1.18E+08 | 0 | *Aeromonas hydrophila* subsp. *hydrophila* ATCC 7966 | *Empedobacter brevis* mature peptide synthesizing enzyme SEQ ID NO: 3. | AED10581 1.00E-130 |
| 249, 250 | alanine racemase [*Aeromonas hydrophila* subsp. *hydrophila* ATCC 7966] | 1.18E+08 | 0 | *Aeromonas hydrophila* subsp. *hydrophila* ATCC 7966 | *Empedobacter brevis* mature peptide synthesizing enzyme SEQ ID NO: 3. | AED10581 1.00E-129 |
| 251, 252 | alanine racemase [*Aeromonas hydrophila* subsp. *hydrophila* ATCC 7966] | 1.18E+08 | 0 | *Aeromonas hydrophila* subsp. *hydrophila* ATCC 7966 | *Empedobacter brevis* mature peptide synthesizing enzyme SEQ ID NO: 3. | AED10581 1.00E-130 |
| 253, 254 | alanine racemase [*Aeromonas hydrophila* subsp. *hydrophila* ATCC 7966] | 1.18E+08 | 0 | *Aeromonas hydrophila* subsp. *hydrophila* ATCC 7966 | *Empedobacter brevis* mature peptide synthesizing enzyme SEQ ID NO: 3. | AED10581 1.00E-129 |
| 255, 256 | hypothetical protein [*Mesorhizobium loti*]. | 13474743 | 1.00E-170 | *Mesorhizobium loti* | *Propionibacterium acnes* predicted ORF-encoded polypeptide #300. | ABM37068 1.00E-77 |

TABLE 3-continued

| | | | | | |
|---|---|---|---|---|---|
| 257, 258 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-129 |
| 259, 260 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-130 |
| 261, 262 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-130 |
| 263, 264 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-128 |
| 265, 266 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-129 |
| 267, 268 | alanine racemase [Aeromonas salmonicida subsp. salmonicida A449] | 1.45E+080 | Aeromonas salmonicida subsp. salmonicida A449 | Empedobacter brevis mature peptide synthesizing enzyme SEQ ID NO: 3. | AED105811.00E-129 |
| 269, 270 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 271, 272 | alanine racemase [Aeromonas hydrophila subsp. hydrophila ATCC 7966] | 1.18E+080 | Aeromonas hydrophila subsp. hydrophila ATCC 7966 | Empedobacter brevis mature peptide synthesizing enzyme SEQ ID NO: 3. | AED105811.00E-132 |
| 273, 274 | alanine racemase [Aeromonas hydrophila subsp. hydrophila ATCC 7966] | 1.18E+080 | Aeromonas hydrophila subsp. hydrophila ATCC | Empedobacter brevis mature peptide synthesizing | AED105811.00E-130 |

TABLE 3-continued

| | | | | | |
|---|---|---|---|---|---|
| | | | 7966 | enzyme SEQ ID NO: 3. | |
| 275, 276 | alanine racemase [*Aeromonas salmonicida* subsp. *salmonicida* A449] | 1.45E+080 | *Aeromonas salmonicida* subsp. *salmonicida* A449 | *Empedobacter brevis* mature peptide synthesizing enzyme SEQ ID NO: 3. | AED105811.00E-128 |
| 277, 278 | alanine racemase [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-133 |
| 279, 280 | alanine racemase [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-132 |
| 281, 282 | alanine racemase [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-132 |
| 283, 284 | alanine racemase [*Aeromonas hydrophila* subsp. *hydrophila* ATCC 7966] | 1.18E+080 | *Aeromonas hydrophila* subsp. *hydrophila* ATCC 7966 | *Empedobacter brevis* mature peptide synthesizing enzyme SEQ ID NO: 3. | AED105811.00E-132 |
| 285, 286 | alanine racemase [*Aeromonas salmonicida* subsp. *salmonicida* A449] | 1.45E+080 | *Aeromonas salmonicida* subsp. *salmonicida* A449 | *Empedobacter brevis* mature peptide synthesizing enzyme SEQ ID NO: 3. | AED105811.00E-130 |
| 287, 288 | alanine racemase [*Aeromonas salmonicida* subsp. *salmonicida* A449] | 1.45E+080 | *Aeromonas salmonicida* subsp. *salmonicida* A449 | *Empedobacter brevis* mature peptide synthesizing enzyme SEQ ID NO: 3. | AED105811.00E-129 |
| 289, 290 | alanine racemase [*Aeromonas salmonicida* subsp. *salmonicida* A449] | 1.45E+080 | *Aeromonas salmonicida* subsp. *salmonicida* A449 | *Empedobacter brevis* mature peptide synthesizing enzyme SEQ ID NO: 3. | AED105811.00E-129 |
| 291, 292 | alanine racemase [*Aeromonas hydrophila* subsp. *hydrophila* ATCC | 1.18E+080 | *Aeromonas hydrophila* subsp. *hydrophila* | *Empedobacter brevis* mature peptide | AED105811.00E-131 |

TABLE 3-continued

| | | | ATCC 7966 | synthesizing enzyme SEQ ID NO: 3. | |
|---|---|---|---|---|---|
| 293, 294 | alanine racemase [*Aeromonas salmonicida* subsp. *salmonicida* A449] | 1.45E+08 0 | *Aeromonas salmonicida* subsp. *salmonicida* A449 | *Empedobacter brevis* mature peptide synthesizing enzyme SEQ ID NO: 3. | AED10581 1.00E-127 |
| 295, 296 | alanine racemase [*Aeromonas hydrophila* subsp. *hydrophila* ATCC 7966] | 1.18E+08 0 | *Aeromonas hydrophila* subsp. *hydrophila* ATCC 7966 | *Empedobacter brevis* mature peptide synthesizing enzyme SEQ ID NO: 3. | AED10581 1.00E-129 |
| 297, 298 | proline racemase [*Burkholderia phymatum* STM815] gi\|117982269\|gb\|EAU96656.1\| proline racemase [*Burkholderia phymatum* STM815] | 1.18E+08 1.00E-104 | *Burkholderia phymatum* STM815 | *Acinetobacter baumannii* protein #19. | ADA35228 1.00E-105 |
| 299, 300 | alanine racemase [*Pseudomonas putida* GB-1] gi\|126314851\|gb\|EAZ66019.1\| alanine racemase [*Pseudomonas putida* GB-1] | 1.26E+08 1.00E-170 | *Pseudomonas putida* GB-1 | *T. maritima* D-alanine-D-alanine ligase. | AED11803 1.00E-169 |
| 301, 302 | alanine racemase [*Pseudomonas putida* KT2440] | 26990430 1.00E-143 | *Pseudomonas putida* KT2440 | *T. maritima* D-alanine-D-alanine ligase. | AED11803 1.00E-144 |
| 303, 304 | hypothetical protein PaerP_01003954 [*Pseudomonas aeruginosa* PA7] | 94414235 4.00E-33 | *Pseudomonas aeruginosa* PA7 | *Pseudomonas aeruginosa* polypeptide #3. | ABO82155 4.00E-33 |
| 305, 306 | AGR_L_3051p [*Agrobacterium tumefaciens*]. | 15891641 1.00E-128 | *Agrobacterium tumefaciens* | *L. pneumophila* protein SEQ ID NO 3367. | AEB41596 3.00E-39 |
| 307, 308 | proline racemase [*Microscilla marina* ATCC 23134] gi\|123984081\|gb\|EAY24454.1\| proline racemase [*Microscilla marina* ATCC 23134] | 1.24E+08 3.00E-59 | *Microscilla marina* ATCC 23134 | Bacterial polypeptide #10001. | ADS22995 3.00E-47 |
| 309, 310 | alanine racemase [*Stenotrophomonas maltophilia* R551-3] gi\|119820021\|gb\|EAX22642.1\| alanine racemase [*Stenotrophomonas maltophilia* R551-3] | 1.2E+08 2.00E-57 | *Stenotrophomonas maltophilia* R551-3 | Prokaryotic essential gene #34740. | ABU41398 8.00E-52 |
| 311, 312 | mandelate racemase/muconate lactonizing enzyme family protein | 83953326 1.00E-143 | *Sulfitobacter* sp. NAS-14.1 | *Klebsiella pneumonia* polypeptide seqid 7178. | ABO61307 2.00E-71 |

TABLE 3-continued

| | | | | | | |
|---|---|---|---|---|---|---|
| | [*Sulfitobacter* sp. NAS-14.1] gi\|83842294\|gb\|EAP81462.1\| mandelate racemase/muconate lactonizing enzyme family protein [*Sulfitobacter* sp. NAS-14.1] | | | | | |
| 313, 314 | proline racemase [*Mesorhizobium loti*]. | 13473394 | 1.00E-120 | *Mesorhizobium loti* | Bacterial polypeptide #10001. | ADS22995 1.00E-120 |
| 315, 316 | proline racemase [*Flavobacteriales bacterium* HTCC2170] gi\|88708932\|gb\|EAR01166.1\| proline racemase [*Flavobacteriales bacterium* HTCC2170] | 88712394 | 1.00E-106 | *Flavobacteriales bacterium* HTCC2170 | Bacterial polypeptide #10001. | ADS22995 1.00E-72 |
| 317, 318 | Mandelate racemase/muconate lactonizing enzyme [*Flavobacteriales bacterium* HTCC2170] gi\|88709134\|gb\|EAR01368.1\| Mandelate racemase/muconate lactonizing enzyme [*Flavobacteriales bacterium* HTCC2170] | 88712596 | 1.00E-110 | *Flavobacteriales bacterium* HTCC2170 | *Bacteroides fragilis* strain 14062 protein, SEQ: 5227. | AEX28600 5.00E-34 |
| 319, 320 | COG3938: Proline racemase [*Pseudomonas aeruginosa* C3719] gi\|84328204\|ref\| ZP_00976211.1\| COG3938: Proline racemase [*Pseudomonas aeruginosa* 2192] gi\|107100719\|ref\| ZP_01364637.1\| hypothetical protein PaerPA_01001746 [*Pseudomonas aeruginosa* PACS2] gi\|12616632 | 84321952 | 1.00E-60 | *Pseudomonas aeruginosa* C3719 | *Pseudomonas aeruginosa* polypeptide #3. | ABO82155 4.00E-61 |
| 321, 322 | aspartate racemase [*Pyrococcus abyssi*]. | 14521575 | 2.00E-28 | *Pyrococcus abyssi* | *Thermococcus kodakaraensis* KOD1 protein sequence SeqID4. | ADN46207 7.00E-25 |
| 323, 324 | proline racemase, putative [*Psychroflexus torquis* ATCC 700755] gi\|91184469\|gb\|EAS70852.1\| proline racemase, putative [*Psychroflexus torquis* ATCC 700755] | 91217361 | 1.00E-152 | *Psychroflexus torquis* ATCC 700755 | Bacterial polypeptide #10001. | ADS22995 1.00E-110 |

TABLE 3-continued

| | | | | | |
|---|---|---|---|---|---|
| 325, 326 | proline racemase [Microscilla marina ATCC 23134] gi\|123984081\|gb\|EAY24454.1\| proline racemase [Microscilla marina ATCC 23134] | 1.24E+08 1.00E-145 | Microscilla marina ATCC 23134 | Bacterial polypeptide #10001. | ADS2299 5 1.00E-126 |
| 327, 328 | proline racemase [Microscilla marina ATCC 23134] gi\|123984081\|gb\|EAY24454.1\| proline racemase [Microscilla marina ATCC 23134] | 1.24E+08 1.00E-147 | Microscilla marina ATCC 23134 | Bacterial polypeptide #10001. | ADS2299 5 1.00E-132 |
| 329, 330 | putative proline racemase [Myxococcus xanthus DK 1622] | 1.09E+08 1.00E-101 | Myxococcus xanthus DK 1622 | M. xanthus protein sequence, seq id 9726. | ABM9663 7 1.00E-101 |
| 331, 332 | AGR_L_3051p [Agrobacterium tumefaciens]. | 15891641 7.00E-44 | Agrobacterium tumefaciens | Bacterial polypeptide #19. | ADF0794 8 5.00E-21 |
| 333, 334 | putative alanine racemase [Rhizobium leguminosarum bv. viciae 3841] | 1.16E+08 9.00E-97 | Rhizobium leguminosarum bv. viciae 3841 | Bacterial polypeptide #19. | ADF0794 8 6.00E-29 |
| 335, 336 | alanine racemase [Moorella thermoacetica ATCC 39073] | 83590990 5.00E-78 | Moorella thermoacetica ATCC 39073 | Prokaryotic essential gene #34740. | ABU2472 1 1.00E-63 |
| 337, 338 | alanine racemase [Moorella thermoacetica ATCC 39073] | 83590990 3.00E-77 | Moorella thermoacetica ATCC 39073 | Prokaryotic essential gene #34740. | ABU2472 1 1.00E-60 |
| 339, 340 | Alanine racemase [Azotobacter vinelandii AvOP] gi\|67087270\|gb\|EAM06737.1\| Alanine racemase [Azotobacter vinelandii AvOP] | 67155469 1.00E-115 | Azotobacter vinelandii AvOP | Prokaryotic essential gene #34740. | ABU3979 5 1.00E-115 |
| 341, 342 | mandelate racemase/muconate lactonizing enzyme [Sphingopyxis alaskensis RB2256] | 1.03E+08 2.00E-99 | Sphingopyxis alaskensis RB2256 | Klebsiella pneumoniae polypeptide seqid 7178. | ABO6130 7 1.00E-45 |
| 343, 344 | putative alanine racemase [Rhizobium leguminosarum bv. viciae 3841] | 1.16E+08 1.00E-127 | Rhizobium leguminosarum bv. viciae 3841 | Pseudomonas aeruginosa polypeptide #3. | ABO8427 4 8.00E-42 |
| 345, 346 | AGR_L_3051p [Agrobacterium tumefaciens]. | 15891641 2.00E-79 | Agrobacterium tumefaciens | Photorhabdus luminescens protein sequence #59. | ABM6911 4 1.00E-27 |
| 347, 348 | putative alanine racemase [Rhizobium leguminosarum bv. viciae 3841] | 1.16E+08 1.00E-114 | Rhizobium leguminosarum bv. viciae 3841 | Prokaryotic essential gene #34740. | ABU4139 8 1.00E-36 |
| 349, 350 | Mandelate racemase/muconate lactonizing | 1.49E+08 2.00E-87 | Methylobacterium sp. 4-46 | Klebsiella pneumoniae polypeptide | ABO6130 7 1.00E-63 |

TABLE 3-continued

| | | | | | |
|---|---|---|---|---|---|
| enzyme; C-terminal domain protein [*Methylobacterium* sp. 4-46] | | | | seqid 7178. | |
| 351, 352 Mandelate racemase/muconate lactonizing enzyme; C-terminal domain protein [*Sphingomonas wittichii* RW1] | 1.49E+08 | 3.00E-93 | *Sphingomonas wittichii* RW1 | *Klebsiella pneumoniae* polypeptide seqid 7178. | ABO6130 73.00E-48 |
| 353, 354 putative proline racemase [*Burkholderia xenovorans* LB400] | 91779222 | 1.00E-38 | *Burkholderia xenovorans* LB400 | Prokaryotic essential gene #34740. | ABU2181 33.00E-39 |
| 355, 356 alanine racemase [*Lentisphaera araneosa* HTCC2155] | 1.49E+08 | 2.00E-67 | *Lentisphaera araneosa* HTCC2155 | Prokaryotic essential gene #34740. | ABU2392 11.00E-56 |
| 357, 358 alanine racemase [*Roseiflexus castenholzii* DSM 13941] gi\|118010932\|gb\|EAV24951.1\| alanine racemase [*Roseiflexus castenholzii* DSM 13941] | 1.18E+08 | 1.00E-107 | *Roseiflexus castenholzii* DSM 13941 | Prokaryotic essential gene #34740. | ABU2392 15.00E-75 |
| 359, 360 alanine racemase [*Roseiflexus castenholzii* DSM 13941] gi\|118010932\|gb\|EAV24951.1\| alanine racemase [*Roseiflexus castenholzii* DSM 13941] | 1.18E+08 | 1.00E-107 | *Roseiflexus castenholzii* DSM 13941 | Prokaryotic essential gene #34740. | ABU2392 11.00E-75 |
| 361, 362 alanine racemase [*Roseiflexus castenholzii* DSM 13941] gi\|118010932\|gb\|EAV24951.1\| alanine racemase [*Roseiflexus castenholzii* DSM 13941] | 1.18E+08 | 1.00E-107 | *Roseiflexus castenholzii* DSM 13941 | Prokaryotic essential gene #34740. | ABU2392 15.00E-75 |
| 363, 364 alanine racemase [*Roseiflexus castenholzii* DSM 13941] gi\|118010932\|gb\|EAV24951.1\| alanine racemase [*Roseiflexus castenholzii* DSM 13941] | 1.18E+08 | 1.00E-107 | *Roseiflexus castenholzii* DSM 13941 | Prokaryotic essential gene #34740. | ABU2392 13.00E-75 |
| 365, 366 alanine racemase [*Roseiflexus castenholzii* DSM 13941] gi\|118010932\|gb\|EAV24951.1\| alanine racemase [*Roseiflexus castenholzii* DSM 13941] | 1.18E+08 | 1.00E-107 | *Roseiflexus castenholzii* DSM 13941 | Prokaryotic essential gene #34740. | ABU2392 13.00E-76 |
| 367, 368 alanine racemase [*Pseudomonas mendocina* ymp] | 1.46E+08 | 1.00E-168 | *Pseudomonas mendocina* ymp | Prokaryotic essential gene #34740. | ABU4139 81.00E-160 |

TABLE 3-continued

| | | | | | |
|---|---|---|---|---|---|
| 369, 370 | diaminopimelate epimerase [*Nostoc* sp. PCC 7120]. | 17232333 | 3.00E-78 | *Nostoc* sp. PCC 7120 | Bacterial polypeptide #10001. | ADS29848 9.00E-79 |
| 371, 372 | diaminopimelate epimerase [*Syntrophus aciditrophicus* SB] | 85857916 | 2.00E-76 | *Syntrophus aciditrophicus* SB | Bacterial polypeptide #10001. | ADN17489 5.00E-60 |
| 373, 374 | diaminopimelate epimerase [*Nostoc* sp. PCC 7120]. | 17232333 | 2.00E-71 | *Nostoc* sp. PCC 7120 | Bacterial polypeptide #10001. | ADS29848 7.00E-72 |
| 375, 376 | Diaminopimelate epimerase [*Clostridium thermocellum* ATCC 27405] | 1.26E+08 | 5.00E-33 | *Clostridium thermocellum* ATCC 27405 | Bacterial polypeptide #10001. | ADN27169 2.00E-31 |
| 377, 378 | UDP-N-acetylglucosamine 2-epimerase [*Chloroflexus aggregans* DSM 9485] gi\|117997290\|gb\|EAV11478.1\| UDP-N-acetylglucosamine 2-epimerase [*Chloroflexus aggregans* DSM 9485] | 1.18E+08 | 2.00E-97 | *Chloroflexus aggregans* DSM 9485 | Prokaryotic essential gene #34740. | ABU24769 6.00E-80 |
| 379, 380 | NmrA family protein [*Burkholderia vietnamiensis* G4] | 1.34E+08 | 2.00E-88 | *Burkholderia vietnamiensis* G4 | Bacterial polypeptide #10001. | ADS22779 2.00E-84 |
| 381, 382 | hypothetical protein RL1205 [*Rhizobium leguminosarum* bv. viciae 3841] | 1.16E+08 | 2.00E-87 | *Rhizobium leguminosarum* bv. viciae 3841 | Bacterial polypeptide #10001. | ADS22779 1.00E-83 |
| 383, 384 | similar to chloromuconate cycloisomerase [*Gloeobacter violaceus* PCC 7421] | 37522668 | 1.00E-93 | *Gloeobacter violaceus* PCC 7421 | *L. pneumophila* protein SEQ ID NO 3367. | AEB37282 4.00E-48 |
| 385, 386 | | | | *Aurantimonas* sp. SI85-9A1 | | AEH19277 5.00E-47 |
| 387, 388 | | | | *Azoarcus* sp. EbN1 | | ABU41398 1.00E-110 |
| 389, 390 | | | | *Enterobacter* sp. 638 | | AEH63094 0 |
| 391, 392 | | | | *Enterobacter* sp. 638 | | AEH63094 0 |
| 393, 394 | | | | *Aquifex aeolicus* VF5 | | ABB06296 1.00E-147 |
| 395, 396 | | | | *Streptomyces coelicolor* A3(2) | | ABU34223 6.00E-90 |
| 397, 398 | | | | *Rhodopseudomonas palustris* HaA2 | | ABO84274 4.00E-50 |

TABLE 3-continued

| | | | |
|---|---|---|---|
| 399, 400 | | Pseudomonas putida F1 | AED11803 0 |
| 401, 402 | | Pseudomonas putida GB-1 | AED11803 1.00E-174 |
| 403, 404 | | Pseudomonas putida GB-1 | AED11804 1.00E-175 |
| 405, 406 | | Pseudomonas putida F1 | AED11804 0 |
| 407, 408 | | Pseudomonas putida F1 | AED11803 0 |
| 409, 410 | | Pseudomonas putida F1 | AED11803 0 |
| 411, 412 | | alpha proteobacterium HTCC2255 | ABB06296 9.00E-13 |
| 413, 414 | | Streptomyces avermitilis MA-4680 | ABM54358 2.00E-53 |
| 415, 416 | | Aeromonas hydrophila subsp. hydrophila ATCC 7966 | AED10581 1.00E-129 |
| 417, 418 | | Aeromonas hydrophila subsp. hydrophila ATCC 7966 | AED10581 1.00E-131 |
| 419, 420 | | Aeromonas hydrophila subsp. hydrophila ATCC 7966 | AED10581 1.00E-132 |
| 421, 422 | | Aeromonas hydrophila subsp. hydrophila ATCC 7966 | AED10581 1.00E-131 |
| 423, 424 | | Pseudomonas putida F1 | AED11803 0 |
| 425, 426 | | Pseudomonas putida F1 | AED11803 1.00E-137 |
| 427, 428 | | Pseudomonas putida GB-1 | AED11803 1.00E-179 |
| 429, 430 | | Pseudomonas putida F1 | AED11804 0 |
| 431, 432 | | Pseudomonas putida F1 | AED11803 0 |
| 433, 434 | | Pseudomonas putida GB-1 | AED11804 1.00E-174 |
| 435, 436 | | Aeromonas hydrophila subsp. | AED10581 1.00E-131 |

TABLE 3-continued

| | | | |
|---|---|---|---|
| | | hydrophila ATCC 7966 | |
| 437, 438 | | Pyrococcus abyssi GE5 | ADN46207 2.00E-25 |
| 439, 440 | | Aeromonas hydrophila subsp. hydrophila ATCC 7966 | AED10581 1.00E-127 |
| 441, 442 | | Aeromonas hydrophila subsp. hydrophila ATCC 7966 | AED10581 1.00E-133 |
| 443, 444 | | Aeromonas hydrophila subsp. hydrophila ATCC 7966 | AED10581 1.00E-132 |
| 445, 446 | | Aeromonas salmonicida subsp. salmonicida A449 | AED10581 1.00E-128 |
| 447, 448 | | Aeromonas hydrophila subsp. hydrophila ATCC 7966 | AED10581 1.00E-129 |
| 449, 450 | | Aeromonas hydrophila subsp. hydrophila ATCC 7966 | AED10581 1.00E-130 |
| 451, 452 | | Aeromonas hydrophila subsp. hydrophila ATCC 7966 | AED10581 1.00E-130 |
| 453, 454 | | Aeromonas salmonicida subsp. salmonicida A449 | AED10581 1.00E-129 |
| 455, 456 | | Stappia aggregata IAM 12614 | ABU21813 1.00E-101 |
| 457, 458 | | Myxococcus xanthus DK 1622 | ABM96637 1.00E-75 |
| 459, 460 | | Aeromonas hydrophila subsp. hydrophila ATCC 7966 | AED10581 1.00E-130 |

TABLE 3-continued

| SEQ ID | Description | | Organism | | |
|---|---|---|---|---|---|
| 461, 462 | | | Pseudomonas putida GB-1 | | AED10581 1.00E-159 |
| 463, 464 | | | Mesorhizobium sp. BNC1 | | ABU38829 3.00E-46 |
| 465, 466 | | | Microscilla marina ATCC 23134 | | ADS22995 1.00E-128 |
| 467, 468 | | | Burkholderia phymatum STM815 | | ADA35228 1.00E-105 |
| 469, 470 | | | Sulfitobacter sp. NAS-14.1 | | ABO61307 2.00E-71 |
| 471, 472 | | | Pseudomonas mendocina ymp | | ABU41398 1.00E-160 |
| 473, 474 | | | Aeromonas hydrophila subsp. hydrophila ATCC 7966 | | AED10581 1.00E-131 |
| 475, 476 | | | Pseudomonas putida GB-1 | | AED10581 1.00E-167 |
| 477, 478 | | | Pseudomonas putida KT2440 | | AED11803 1.00E-141 |
| 479, 480 | protein of unknown function DUF453 [Novosphingobium aromaticivorans DSM 12444] | 87200831 1.00E-137 | Novosphingobium aromaticivorans DSM 12444 | Klebsiella pneumoniae polypeptide seqid 7178. | ABO64182 1.00E-113 |
| 481, 482 | alanine racemase [Aeromonas hydrophila subsp. hydrophila ATCC 7966] | 1.18E+08 1.00E-177 | Aeromonas hydrophila subsp. hydrophila ATCC 7966 | Empedobacter brevis mature peptide synthesizing enzyme SEQ ID NO: 3. | AED10581 1.00E-129 |
| 483, 484 | threonine aldolase family protein [Caulobacter crescentus CB15] gi\|13424764\|gb\|AAK25068.1\| threonine aldolase family protein [Caulobacter crescentus CB15] | 16127336 0 | Caulobacter crescentus CB15 | | |
| 485, 486 | hypothetical protein AGR_L_1837 [Agrobacterium tumefaciens str. C58] gi\|17937630\|ref\| NP_534419.1\| hypothetical protein Atu3927 [Agrobacterium tumefaciens str. C58] | 15891036 0 | Agrobacterium tumefaciens str. C58 | | |

TABLE 3-continued gi|15159365|gb|AAK89493.1|
AGR_L_1837p
[*Agrobacterium tumefaciens* str. C58]
gi|17742368|gb|AAL44735.1|
conserved hypothetical protein
[*Agrobacterium tumefaciens* str. C58]

| SEQ ID NO: | Geneseq DNA Description | | |
|---|---|---|---|
| 487, 488 | hypothetical protein AGR_L_1808 [*Agrobacterium tumefaciens* str. C58] gi|15159347|gb|AAK89478.1| AGR_L_1808p [*Agrobacterium tumefaciens* str. C58] | 158910210 | *Agrobacterium tumefaciens* str. C58 |

| SEQ ID NO: | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|
| 3, 4 | *Aquifex pyrophilus* heat resistant alanine racemase encoding DNA. | ABL49607 | 2.00E-07 | 5.1.1.1 | 1017 | 338 | 0 | 338 | 100 | |
| 5, 6 | Human immune/haematopoietic antigen genomic sequence SEQ ID NO: 41436. | AAK80650 | 0.032 | 2.7.3. | 720 | 239 | 0 | 239 | 80 | |
| 7, 8 | EST clone EP219. | AAV88076 | 0.048 | | 1032 | 343 | 0 | 343 | 89 | |
| 9, 10 | *Pseudomonas aeruginosa* polypeptide #3. | ABD08732 | 1.00E-05 | 5.1.1.1 | 1149 | 382 | 0 | 391 | 78 | |
| 11, 12 | *Pseudomonas aeruginosa* polypeptide #3. | ABD06378 | 0.013 | 5.1.1.1 | 1122 | 373 | 0 | 388 | 58 | |
| 13, 14 | *Pseudomonas aeruginosa* polypeptide #3. | ABD08732 | 1.00E-08 | 5.1.1.1 | 1065 | 354 | 0 | 353 | 64 | |
| 15, 16 | *Klebsiella pneumoniae* polypeptide seqid 7178. | ACH99054 | 0.002 | 5.1.1.13 | 702 | 233 | 0 | 231 | 74 | |
| 17, 18 | Human phosphodiesterase 4D amino acid sequence N1 SEQ ID NO: 7. | AEB85185 | 0.009 | 5.1.1.3 | 807 | 268 | 0 | 269 | 72 | |

TABLE 3-continued

| | | | | | | | | |
|---|---|---|---|---|---|---|---|---|
| 19, 20 | *M. xanthus* protein sequence, seq id 9726. | ACL64794 | 0.037 | 5.1.1.3 | 822 | 273 | 0 | 272 | 53 |
| 21, 22 | Bacterial polypeptide #10001. | ADS61806 | 1.00E-04 | 5.2.1.1 | 768 | 255 | 0 | 265 | 41 |
| 23, 24 | *Enterobacter cloacae* protein amino acid sequence - SEQ ID 5666. | AEH55699 | 0 | 5.1.1.1 | 1080 | 359 | 0 | 359 | 95 |
| 25, 26 | *Enterobacter cloacae* protein amino acid sequence - SEQ ID 5666. | AEH55699 | 0 | 5.1.1.1 | 1080 | 359 | 0 | 359 | 95 |
| 27, 28 | Prokaryotic essential gene #34740. | ACA27845 | 0.002 | 2.7.3. | 651 | 216 | 0 | 216 | 100 |
| 29, 30 | *Pseudomonas aeruginosa* polypeptide #3. | ABD15676 | 1.00E-08 | 5.1.1.4 | 1032 | 343 | 0 | 342 | 64 |
| 31, 32 | *Pseudomonas aeruginosa* polypeptide #3. | ABD15666 | 9.00E-16 | 5.1.1.4 | 1011 | 336 | 0 | 310 | 58 |
| 33, 34 | Human cancer associated cDNA SEQ ID NO 9. | AEH98530 | 0.013 | 5.1.1.1 | 1116 | 371 | 0 | 385 | 61 |
| 35, 36 | *N. meningitidis* partial DNA sequence gnm_640 SEQ ID NO: 640. | AAA81486 | 3.2 | 5.1.1. | 1101 | 366 | 0 | 368 | 33 |
| 37, 38 | *Pseudomonas aeruginosa* polypeptide #3. | ABD12586 | 0.32 | 5.1.1.1 | 489 | 162 | 0 | 369 | 51 |
| 39, 40 | Prokaryotic essential gene #34740. | ACA26332 | 8.00E-23 | 5.1.1.4 | 372 | 123 | 960 | 318 | |
| 41, 42 | *Pseudomonas putida* racemase peptide, SEQ ID 5. | ADB99538 | 0 | 5.1.1.1 | 1230 | 409 | 0 | 409 | 97 |
| 43, 44 | *Pseudomonas putida* racemase peptide, SEQ ID 5. | ADB99538 | 0 | 5.1.1.1 | 1230 | 409 | 0 | 409 | 96 |

TABLE 3-continued

| | | | | | | | | | |
|---|---|---|---|---|---|---|---|---|---|
| 45, 46 | *Pseudomonas putida* racemase peptide, SEQ ID 5. | ADB99538 | 0 | 5.1.1.1 | 1230 | 409 | 0 | 409 | 97 |
| 47, 48 | *Pseudomonas putida* racemase peptide, SEQ ID 5. | ADB99538 | 0 | 5.1.1.1 | 1230 | 409 | 0 | 409 | 97 |
| 49, 50 | *Pseudomonas putida* racemase peptide, SEQ ID 5. | ADB99538 | 0 | 5.1.1.1 | 1230 | 409 | 0 | 409 | 96 |
| 51, 52 | *Pseudomonas putida* racemase peptide, SEQ ID 5. | ADB99537 | 1.00E-120 | 5.1.1.1 | 1230 | 409 | 0 | 409 | 77 |
| 53, 54 | *Pseudomonas putida* racemase peptide, SEQ ID 5. | ADB99537 | 1.00E-124 | 5.1.1.1 | 1230 | 409 | 0 | 409 | 77 |
| 55, 56 | *Pseudomonas putida* racemase peptide, SEQ ID 5. | ADB99537 | 1.00E-124 | 5.1.1.1 | 1230 | 409 | 0 | 409 | 77 |
| 57, 58 | *Pseudomonas putida* racemase peptide, SEQ ID 5. | ADB99538 | 0 | 5.1.1.1 | 1230 | 409 | 0 | 409 | 96 |
| 59, 60 | *Pseudomonas putida* racemase peptide, SEQ ID 5. | ADB99538 | 0 | 5.1.1.1 | 1230 | 409 | 0 | 409 | 95 |
| 61, 62 | Human prostate expression marker cDNA 6604. | ABV52203 | 0.077 | 5.1.1.1 | 1614 | 537 | 0 | 354 | 19 |
| 63, 64 | *Pseudomonas putida* racemase peptide, SEQ ID 5. | ADB99537 | 0 | 5.1.1.1 | 1230 | 409 | 0 | 409 | 98 |
| 65, 66 | *Pseudomonas putida* racemase peptide, SEQ ID 5. | ADB99537 | 0 | 5.1.1.1 | 1230 | 409 | 0 | 409 | 97 |
| 67, 68 | *Pseudomonas putida* racemase peptide, SEQ ID 5. | ADB99538 | 0 | 5.1.1.1 | 1230 | 409 | 0 | 409 | 90 |
| 69, 70 | *Pseudomonas putida* racemase peptide, SEQ ID 5. | ADB99537 | 0 | 5.1.1.1 | 1230 | 409 | 0 | 409 | 95 |

TABLE 3-continued

| | | | | | | | | | |
|---|---|---|---|---|---|---|---|---|---|
| 71, 72 | *Pseudomonas putida* racemase peptide SEQ ID 5. | ADB99537 | 0 | 5.1.1.1 | 1230 | 409 | 0 | 409 | 96 |
| 73, 74 | *Pseudomonas putida* racemase peptide, SEQ ID 5. | ADB99537 | 0 | 5.1.1.1 | 1230 | 409 | 0 | 409 | 95 |
| 75, 76 | *Pseudomonas putida* racemase peptide, SEQ ID 5. | ADB99537 | 0 | 5.1.1.1 | 1230 | 409 | 0 | 409 | 95 |
| 77, 78 | *Pseudomonas putida* racemase peptida, SEQ ID 5. | ADB99538 | 0 | 5.1.1.1 | 1230 | 409 | 0 | 409 | 95 |
| 79, 80 | *Pseudomonas putida* racemase peptide, SEQ ID 5. | ADB99538 | 0 | 5.1.1.1 | 1230 | 409 | 0 | 409 | 95 |
| 81, 82 | *Pseudomonas putida* racemase peptide, SEQ ID 5. | ADB99538 | 0 | 5.1.1.1 | 1230 | 409 | 0 | 409 | 96 |
| 83, 84 | *Pseudomonas putida* racemase peptide, SEQ ID 5. | ADB99538 | 0 | 5.1.1.1 | 1230 | 409 | 0 | 409 | 94 |
| 85, 86 | *Pseudomonas putida* racemase peptide, SEQ ID 5. | ADB99537 | 0 | 5.1.1.1 | 1230 | 409 | 0 | 409 | 96 |
| 87, 88 | *Pseudomonas putida* racemase peptide, SEQ ID 5. | ADB99538 | 0 | 5.1.1.1 | 1230 | 409 | 0 | 409 | 96 |
| 89, 90 | *Pseudomonas putida* racemase peptide, SEQ ID 5. | ADB99537 | 0 | 5.1.1.1 | 1230 | 409 | 0 | 409 | 96 |
| 91, 92 | *Pseudomonas putida* racemase peptide, SEQ ID 5. | ADB99538 | 0 | 5.1.1.1 | 1230 | 409 | 0 | 409 | 96 |
| 93, 94 | *Pseudomonas putida* racemase peptide, SEQ ID 5. | ADB99538 | 0 | 5.1.1.1 | 1230 | 409 | 0 | 409 | 96 |
| 95, 96 | *Pseudomonas putida* racemase peptide, SEQ ID 5. | ADB99537 | 0 | 5.1.1.1 | 1230 | 409 | 0 | 409 | 95 |

TABLE 3-continued

| SEQ IDs | Description | Accession | E-value | EC | | | | | |
|---|---|---|---|---|---|---|---|---|---|
| 97, 98 | *Pseudomonas putida* racemase peptide, SEQ ID 5. | ADB99537 | 0 | 5.1.1.1 | 1230 | 409 | 0 | 409 | 96 |
| 99, 100 | *Pseudomonas putida* racemase peptide, SEQ ID 5. | ADB99537 | 0 | 5.1.1.1 | 1230 | 409 | 0 | 409 | 97 |
| 101, 102 | *Enterobacter cloacae* protein amino acid sequence- SEQ ID 5666. | AEH53103 | 5.00E-27 | 5.1.1.1 | 384 | 127 | 1071 | 356 | 86 | 76 |
| 103, 104 | Prokaryotic essential gene #34740. | ACA27539 | 0.13 | 5.1.1.13 | 714 | 237 | 687 | 228 | 32 | 48 |
| 105, 106 | Bovine ABCG2 related PCR primer #31. | AEN69487 | 2.9 | 5.1.1.4 | 1002 | 333 | 0 | 333 | 75 |
| 107, 108 | *Pseudomonas putida* racemase peptide, SEQ ID 5. | ADB99538 | 6.00E-11 | 5.1.1.1 | 1227 | 408 | 0 | 408 | 96 |
| 109, 110 | *Pseudomonas putida* racemase peptide, SEQ ID 5. | ADB99538 | 6.00E-05 | 5.1.1.1 | 1227 | 408 | 0 | 408 | 95 |
| 111, 112 | *Pseudomonas putida* racemase peptide, SEQ ID 5. | ADB99538 | 2.00E-11 | 5.1.1.1 | 1227 | 408 | 0 | 408 | 99 |
| 113, 114 | *Pseudomonas putida* racemase peptide, SEQ ID 5. | ADB99538 | 2.00E-14 | 5.1.1.1 | 1224 | 407 | 0 | 408 | 92 |
| 115, 116 | *Pseudomonas putida* racemase peptide, SEQ ID 5. | ADB99538 | 2.00E-08 | 5.1.1.1 | 1227 | 408 | 0 | 408 | 92 |
| 117, 118 | *Pseudomonas putida* racemase peptide, SEQ ID 5. | ADB99538 | 6.00E-11 | 5.1.1.1 | 1227 | 408 | 0 | 408 | 92 |
| 119, 120 | *Pseudomonas putida* racemase peptide, SEQ ID 5. | ADB99538 | 1.00E-12 | 5.1.1.1 | 1227 | 408 | 0 | 408 | 95 |

TABLE 3-continued

| | | | | | | | | |
|---|---|---|---|---|---|---|---|---|
| 121, 122 | *Pseudomonas putida* racemase peptide, SEQ ID 5. | ADB99538 | 2.00E-26 | 5.1.1.1 | 1086 | 361 | 1227 | 409 |
| 123, 124 | *Pseudomonas putida* racemase peptide, SEQ ID 5. | ADB99538 | 6.00E-11 | 5.1.1.1 | 1086 | 361 | 0 | 408 | 88 |
| 125, 126 | *Pseudomonas putida* racemase peptide, SEQ ID 5. | ADB99538 | 4.00E-95 | 5.1.1.1 | 1086 | 361 | 1227 | 386 |
| 127, 128 | Prokaryotic essential gene #34740. | ACA37866 | 2.2 | 5.1.1.3 | 261 | 86 | 0 | 265 | 63 |
| 129, 130 | Prokaryotic essential gene #34740. | ACA26332 | 5.00E-11 | 5.1.1.4 | 957 | 318 | 0 | 310 | 56 |
| 131, 132 | Prokaryotic essential gene #34740. | ACA26332 | 1.00E-18 | 5.1.1.4. | 1074 | 357 | 960 | 311 |
| 133, 134 | *Pseudomonas putida* racemase peptide, SEQ ID 5. | ADB99538 | 6.00E-11 | 5.1.1.1 | 1227 | 408 | 0 | 408 | 99 |
| 135, 136 | *Pseudomonas putida* racemase peptide, SEQ ID 5. | ADB99538 | 6.00E-05 | 5.1.1.1 | 1227 | 408 | 0 | 408 | 95 |
| 137, 138 | *Pseudomonas putida* racemase peptide, SEQ ID 5. | ADB99538 | 0.004 | 5.1.1.1 | 1221 | 406 | 0 | 408 | 95 |
| 139, 140 | *Pseudomonas putida* racemase peptide, SEQ ID 5. | ADB99538 | 6.00E-11 | 5.1.1.1 | 1224 | 407 | 0 | 408 | 99 |
| 141, 142 | *Pseudomonas putida* racemase peptide, SEQ ID 5. | ADB99538 | 1.00E-15 | 5.1.1.1 | 1227 | 408 | 0 | 408 | 89 |
| 143, 144 | *Pseudomonas putida* racemase peptide, SEQ ID 5. | ADB99538 | 6.00E-11 | 5.1.1.1 | 1227 | 408 | 0 | 408 | 100 |
| 145, 146 | *Pseudomonas putida* racemase peptide, SEQ ID 5. | ADB99538 | 2.00E-11 | 5.1.1.1 | 1224 | 407 | 0 | 408 | 99 |

TABLE 3-continued

| | | | | | | | | | |
|---|---|---|---|---|---|---|---|---|---|
| 147, 148 | Pseudomonas putida racemase peptide, SEQ ID 5. | ADB99538 | 3.00E-19 | 5.1.1.1 | 1224 | 407 | 0 | 408 | 97 |
| 149, 150 | Pseudomonas putida racemase peptide, SEQ ID 5. | ADB99538 | 6.00E-19 | 5.1.1.1 | 1227 | 408 | 0 | 408 | 93 |
| 151, 152 | Pseudomonas putida racemase peptide, SEQ ID 5. | ADB99538 | 3.00E-19 | 5.1.1.1 | 1227 | 408 | 0 | 408 | 92 |
| 153, 154 | Pseudomonas putida racemase peptide, SEQ ID 5. | ADB99538 | 3.00E-19 | 5.1.1.1 | 1224 | 407 | 0 | 408 | 97 |
| 155, 156 | Pseudomonas putida racemase peptide, SEQ ID 5. | ADB99538 | 2.00E-14 | 5.1.1.1 | 1227 | 408 | 0 | 408 | 96 |
| 157, 158 | Pseudomonas putida racemase peptide, SEQ ID 5. | ADB99538 | 6.00E-11 | 5.1.1.1 | 1227 | 408 | 0 | 408 | 92 |
| 159, 160 | Pseudomonas putida racemase peptide, SEQ ID 5. | ADB99538 | 6.00E-11 | 5.1.1.1 | 1227 | 408 | 0 | 408 | 92 |
| 161, 162 | Pseudomonas putida racemase peptide, SEQ ID 5. | ADB99538 | 3.00E-19 | 5.1.1.1 | 1227 | 408 | 0 | 408 | 97 |
| 163, 164 | Pseudomonas putida racemase peptide, SEQ ID 5. | ADB99538 | 1.00E-64 | 5.1.1.1 | 1086 | 361 | 1227 | 386 | |
| 165, 166 | Pseudomonas putida racemase peptide, SEQ ID 5. | ADB99538 | 2.00E-91 | 5.1.1.1 | 1083 | 360 | 1227 | 386 | |
| 167, 168 | Bacterial polypeptide #10001. | ADS60041 | 0.007 | 5.1.1.4 | 657 | 218 | 0 | 335 | 58 |
| 169, 170 | Pseudomonas putida racemase peptide, SEQ ID 5. | ADB99538 | 6.00E-11 | 5.1.1.1 | 1227 | 408 | 0 | 408 | 97 |
| 171, 172 | Pseudomonas putida racemase peptide, SEQ ID 5. | ADB99538 | 6.00E-11 | 5.1.1.1 | 1227 | 408 | 0 | 408 | 96 |

TABLE 3-continued

| | | | | | | | | | |
|---|---|---|---|---|---|---|---|---|---|
| 173, 174 | *Pseudomonas putida* racemase peptide, SEQ ID 5. | ADB99538 | 6.00E-05 | 5.1.1.1 | 1224 | 407 | 0 | 408 | 95 |
| 175, 176 | *Pseudomonas putida* racemase peptide, SEQ ID 5. | ADB99538 | 2.00E-14 | 5.1.1.1 | 1227 | 408 | 0 | 408 | 89 |
| 177, 178 | *Pseudomonas putida* racemase peptide, SEQ ID 5. | ADB99538 | 6.00E-11 | 5.1.1.1 | 1227 | 408 | 0 | 408 | 99 |
| 179, 180 | *Pseudomonas putida* racemase peptide, SEQ ID 5. | ADB99538 | 3.00E-10 | 5.1.1.1 | 1227 | 408 | 0 | 408 | 99 |
| 181, 182 | *Pseudomonas putida* racemase peptide, SEQ ID 5. | ADB99538 | 6.00E-11 | 5.1.1.1 | 1227 | 408 | 0 | 408 | 99 |
| 183, 184 | *Pseudomonas putida* racemase peptide, SEQ ID 5. | ADB99538 | 6.00E-11 | 5.1.1.1 | 1227 | 408 | 0 | 408 | 100 |
| 185, 186 | *Pseudomonas putida* racemase peptide, SEQ ID 5. | ADB99538 | 1.00E-15 | 5.1.1.1 | 1227 | 408 | 0 | 408 | 89 |
| 187, 188 | *Pseudomonas putida* racemase peptide, SEQ ID 5. | ADB99538 | 6.00E-11 | 5.1.1.1 | 1227 | 408 | 0 | 408 | 99 |
| 189, 190 | *Pseudomonas putida* racemase peptide, SEQ ID 5. | ADB99538 | 6.00E-11 | 5.1.1.1 | 1227 | 408 | 0 | 408 | 99 |
| 191, 192 | *Pseudomonas putida* racemase peptide, SEQ ID 5. | ADB99538 | 6.00E-11 | 5.1.1.1 | 1227 | 408 | 0 | 408 | 91 |
| 193, 194 | *Pseudomonas putida* racemase peptide, SEQ ID 5. | ADB99538 | 6.00E-11 | 5.1.1.1 | 1227 | 408 | 0 | 408 | 92 |
| 195, 196 | *Pseudomonas putida* racemase peptide, SEQ ID 5. | ADB99537 | 6.00E-11 | 5.1.1.1 | 1227 | 408 | 0 | 408 | 92 |
| 197, 198 | *Pseudomonas putida* racemase peptide, SEQ ID 5. | ADB99538 | 2.00E-14 | 5.1.1.1 | 1227 | 408 | 0 | 408 | 91 |

TABLE 3-continued

| | | | | | | | | |
|---|---|---|---|---|---|---|---|---|
| 199, 200 | *Pseudomonas putida* racemase peptide, SEQ ID 5. | ADB99538 | 1.00E-15 | 5.1.1.1 | 1227 | 408 | 0 | 408 | 90 |
| 201, 202 | *Pseudomonas putida* racemase peptide, SEQ ID 5. | ADB99538 | 1.00E-15 | 5.1.1.1 | 1227 | 408 | 0 | 408 | 89 |
| 203, 204 | *Pseudomonas putida* racemase peptide, SEQ ID 5. | ADB99538 | 4.00E-18 | 5.1.1.1 | 1227 | 408 | 0 | 408 | 92 |
| 205, 206 | *Pseudomonas putida* racemase peptide, SEQ ID 5. | ADB99538 | 1.00E-15 | 5.1.1.1 | 1227 | 408 | 0 | 408 | 89 |
| 207, 208 | *Pseudomonas putida* racemase peptide, SEQ ID 5. | ADB99538 | 3.00E-16 | 5.1.1.1 | 1224 | 407 | 0 | 408 | 92 |
| 209, 210 | *Pseudomonas putida* racemase peptide, SEQ ID 5. | ADB99538 | 1.00E-12 | 5.1.1.1 | 1227 | 408 | 0 | 408 | 91 |
| 211, 212 | *Pseudomonas putida* racemase peptide, SEQ ID 5. | ADB99538 | 2.00E-14 | 5.1.1.1 | 1224 | 407 | 0 | 408 | 89 |
| 213, 214 | *Pseudomonas putida* racemase peptide, SEQ ID 5. | ADB99538 | 1.00E-15 | 5.1.1.1 | 1224 | 407 | 0 | 408 | 91 |
| 215, 216 | *Pseudomonas putida* racemase peptide, SEQ ID 5. | ADB99538 | 6.00E-11 | 5.1.1.1 | 1227 | 408 | 0 | 408 | 96 |
| 217, 218 | *Pseudomonas putida* racemase peptide, SEQ ID 5. | ADB99538 | 7.00E-14 | 5.1.1.1 | 1224 | 407 | 0 | 408 | 92 |
| 219, 220 | *Pseudomonas putida* racemase peptide, SEQ ID 5. | ADB99538 | 6.00E-11 | 5.1.1.1 | 1227 | 408 | 0 | 408 | 95 |
| 221, 222 | *Pseudomonas putida* racemase peptide, SEQ ID 5. | ADB99538 | 6.00E-11 | 5.1.1.1 | 1224 | 407 | 0 | 408 | 95 |
| 223, 224 | *Pseudomonas putida* racemase peptide, SEQ ID 5. | ADB99538 | 2.00E-14 | 5.1.1.1 | 1224 | 407 | 0 | 408 | 93 |

TABLE 3-continued

| | | | | | | | | |
|---|---|---|---|---|---|---|---|---|
| 225, 226 | *Pseudomonas putida* racemase peptide, SEQ ID 5. | ADB99538 | 6.00E-11 | 5.1.1.1 | 1227 | 408 | 0 | 408 | 94 |
| 227, 228 | *Pseudomonas putida* racemase peptide, SEQ ID 5. | ADB99538 | 2.00E-14 | 5.1.1.1 | 1227 | 408 | 0 | 408 | 91 |
| 229, 230 | *Pseudomonas putida* racemase peptide, SEQ ID 5. | ADB99538 | 3.00E-13 | 5.1.1.1 | 1227 | 408 | 0 | 408 | 91 |
| 231, 232 | *Pseudomonas putida* racemase peptide, SEQ ID 5. | ADB99538 | 6.00E-11 | 5.1.1.1 | 1227 | 408 | 0 | 408 | 95 |
| 233, 234 | *Pseudomonas putida* racemase peptide, SEQ ID 5. | ADB99538 | 6.00E-11 | 5.1.1.1 | 1227 | 408 | 0 | 408 | 95 |
| 235, 236 | *Pseudomonas putida* racemase peptide, SEQ ID 5. | ADB99538 | 6.00E-05 | 5.1.1.1 | 1224 | 407 | 0 | 408 | 95 |
| 237, 238 | *Pseudomonas putida* racemase peptide, SEQ ID 5. | ADB99538 | 6.00E-05 | 5.1.1.1 | 1227 | 408 | 0 | 408 | 96 |
| 239, 240 | *Pseudomonas putida* racemase peptide, SEQ ID 5. | ADB99538 | 6.00E-11 | 5.1.1.1 | 1224 | 407 | 0 | 408 | 94 |
| 241, 242 | *Pseudomonas putida* racemase peptide, SEQ ID 5. | ADB99538 | 6.00E-11 | 5.1.1.1 | 1227 | 408 | 0 | 408 | 95 |
| 243, 244 | *Pseudomonas putida* racemase peptide, SEQ ID 5. | ADB99538 | 4.00E-06 | 5.1.1.1 | 1227 | 408 | 0 | 408 | 95 |
| 245, 246 | *Pseudomonas putida* racemase peptide, SEQ ID 5. | ADB99538 | 4.00E-06 | 5.1.1.1 | 1227 | 408 | 0 | 408 | 95 |
| 247, 248 | *Pseudomonas putida* racemase peptide, SEQ ID 5. | ADB99538 | 4.00E-06 | 5.1.1.1 | 1227 | 408 | 0 | 408 | 96 |
| 249, 250 | *Pseudomonas putida* racemase peptide, SEQ ID 5. | ADB99538 | 4.00E-06 | 5.1.1.1 | 1227 | 408 | 0 | 408 | 95 |

TABLE 3-continued

| | | | | | | | | | |
|---|---|---|---|---|---|---|---|---|---|
| 251, 252 | *Pseudomonas putida* racemase peptide, SEQ ID 5. | ADB99538 | 4.00E-06 | 5.1.1.1 | 1227 | 408 | 0 | 408 | 95 |
| 253, 254 | *Pseudomonas putida* racemase peptide, SEQ ID 5. | ADB99538 | 4.00E-06 | 5.1.1.1 | 1224 | 407 | 0 | 408 | 95 |
| 255, 256 | Plant polypeptide, SEQ ID 5546. | ADT17374 | 0.2 | 5.1.1.1 | 1086 | 361 | 1827 | 608 | 83  80 |
| 257, 258 | *Pseudomonas putida* racemase peptide, SEQ ID 5. | ADB99538 | 2.00E-08 | 5.1.1.1 | 1227 | 408 | 0 | 408 | 95 |
| 259, 260 | *Pseudomonas putida* racemase peptide, SEQ ID 5. | ADB99538 | 6.00E-11 | 5.1.1.1 | 1227 | 408 | 0 | 408 | 95 |
| 261, 262 | *Pseudomonas putida* racemase peptide, SEQ ID 5. | ADB99538 | 2.00E-08 | 5.1.1.1 | 1227 | 408 | 0 | 408 | 94 |
| 263, 264 | *Pseudomonas putida* racemase peptide, SEQ ID 5. | ADB99538 | 6.00E-11 | 5.1.1.1 | 1227 | 408 | 0 | 408 | 95 |
| 265, 266 | *Pseudomonas putida* racemase peptide, SEQ ID 5. | ADB99538 | 6.00E-11 | 5.1.1.1 | 1227 | 408 | 0 | 408 | 95 |
| 267, 268 | *Pseudomonas putida* racemase peptide, SEQ ID 5. | ADB99538 | 6.00E-11 | 5.1.1.1 | 1227 | 408 | 0 | 408 | 94 |
| 269, 270 | *Pseudomonas putida* racemase peptide, SEQ ID 5. | ADB99538 | 1.00E-12 | 5.1.1.1 | 1227 | 408 | 0 | 408 | 92 |
| 271, 272 | *Pseudomonas putida* racemase peptide, SEQ ID 5. | ADB99538 | 3.00E-13 | 5.1.1.1 | 1230 | 409 | 0 | 408 | 92 |
| 273, 274 | *Pseudomonas putida* racemase peptide, SEQ ID 5. | ADB99538 | 6.00E-11 | 5.1.1.1 | 1227 | 408 | 0 | 408 | 96 |
| 275, 276 | *Pseudomonas putida* racemase peptide, SEQ ID 5. | ADB99538 | 6.00E-11 | 5.1.1.1 | 1227 | 408 | 0 | 408 | 97 |

TABLE 3-continued

| | | | | | | | | |
|---|---|---|---|---|---|---|---|---|
| 277, 278 | *Pseudomonas putida* racemase peptide, SEQ ID 5. | ADB99538 | 2.00E-14 | 5.1.1.1 | 1227 | 408 | 0 | 408 | 92 |
| 279, 280 | *Pseudomonas putida* racemase peptide, SEQ ID 5. | ADB99538 | 1.00E-15 | 5.1.1.1 | 1227 | 408 | 0 | 408 | 92 |
| 281, 282 | *Pseudomonas putida* racemase peptide, SEQ ID 5. | ADB99538 | 1.00E-18 | 5.1.1.1 | 1227 | 408 | 0 | 408 | 92 |
| 283, 284 | *Pseudomonas putida* racemase peptide, SEQ ID 5. | ADB99538 | 1.00E-18 | 5.1.1.1 | 1227 | 408 | 0 | 408 | 92 |
| 285, 286 | *Pseudomonas putida* racemase peptide, SEQ ID 5. | ADB99538 | 6.00E-11 | 5.1.1.1 | 1227 | 408 | 0 | 408 | 95 |
| 287, 288 | *Pseudomonas putida* racemase peptide, SEQ ID 5. | ADB99538 | 6.00E-11 | 5.1.1.1 | 1227 | 408 | 0 | 408 | 95 |
| 289, 290 | *Pseudomonas putida* racemase peptide, SEQ ID 5. | ADB99538 | 6.00E-11 | 5.1.1.1 | 1227 | 408 | 0 | 408 | 95 |
| 291, 292 | *Pseudomonas putida* racemase peptide, SEQ ID 5. | ADB99538 | 2.00E-14 | 5.1.1.1 | 1227 | 408 | 0 | 408 | 92 |
| 293, 294 | *Pseudomonas putida* racemase peptide, SEQ ID 5. | ADB99538 | 6.00E-11 | 5.1.1.1 | 1227 | 408 | 0 | 408 | 94 |
| 295, 296 | *Pseudomonas putida* racemase peptide, SEQ ID 5. | ADB99538 | 4.00E-06 | 5.1.1.1 | 1227 | 408 | 0 | 408 | 95 |
| 297, 298 | Prokaryotic essential gene #34740. | ACA19650 | 9.00E-22 | 5.1.1.4 | 960 | 319 | 945 | 331 | |
| 299, 300 | *Pseudomonas putida* racemase peptide, SEQ ID 5. | ADB99538 | 5.00E-95 | 5.1.1.1 | 1230 | 409 | 0 | 409 | 73 |
| 301, 302 | *Pseudomonas putida* racemase peptide, SEQ ID 5. | ADB99538 | 5.00E-27 | 5.1.1.1 | 1239 | 412 | 1227 | 409 | |

TABLE 3-continued

| | | | | | | | | | |
|---|---|---|---|---|---|---|---|---|---|
| 303, 304 | Prokaryotic essential gene #34740. | ACA44058 | 7.00E-14 | 5.1.1.4 | 375 | 124 | 0 | 314 | 60 |
| 305, 306 | Prokaryotic essential gene #34740. | ACA27267 | 0.21 | 5.1.1.1 | 1125 | 374 | 1167 | 388 | 64 66 |
| 307, 308 | Bacterial polypeptide #10001. | ADS60041 | 2.00E-05 | 5.1.1.4 | 429 | 142 | 0 | 333 | 73 |
| 309, 310 | Prokaryotic essential gene #34740. | ACA43665 | 3.00E-13 | 5.1.1.1 | 408 | 135 | 0 | 355 | 80 |
| 311, 312 | Novel mar regulated protein (NlMR) #29. | AAS46252 | 0.67 | 5.1.2.2 | 939 | 312 | 0 | 321 | 81 |
| 313, 314 | *C. botulinum* active BoNT/A modified open reading frame, SEQ ID No: 7. | AEF99607 | 0.65 | 5.1.1.4 | 909 | 302 | 1002 | 333 | 70 62 |
| 315, 316 | *Haemophilus influenzae* (NTHi) protein - SEQ ID 618. | ADT05504 | 0.03 | 5.1.1.4 | 684 | 227 | 0 | 335 | 79 |
| 317, 318 | Prokaryotic essential gene #34740. | ACA23465 | 2.9 | 5.5.1.1 | 1032 | 343 | 0 | 348 | 57 |
| 319, 320 | *Pseudomonas aeruginosa* polypeptide #3. | ABD15666 | 3.00E-05 | 5.1.1.4 | 636 | 211 | 486 | 339 | |
| 321, 322 | Breast cancer related marker, seq id 2. | ACN89360 | 0.49 | 5.1.1.13 | 699 | 232 | 687 | 228 | 31 46 |
| 323, 324 | Bacterial polypeptide #10001. | ADS60041 | 0.16 | 5.1.1.4 | 885 | 294 | 0 | 336 | 85 |
| 325, 326 | Bacterial polypeptide #10001. | ADS60041 | 5.00E-08 | 5.1.1.4 | 1005 | 334 | 0 | 333 | 73 |
| 327, 328 | Bacterial polypeptide #10001. | ADS60041 | 0.012 | 5.1.1.4 | 1002 | 333 | 0 | 333 | 74 |
| 329, 330 | Prokaryotic essential gene #34740. | ACA23259 | 1.00E-17 | 5.1.1.4 | 957 | 318 | 0 | 311 | 58 |
| 331, 332 | *Mycobacterium tuberculosis* strain H37Rv | AAI99682 | 1.1 | 5.1.1.1 | 420 | 139 | 1167 | 388 | 61 68 |

TABLE 3-continued

| | | | | | | | | | |
|---|---|---|---|---|---|---|---|---|---|
| | genome SEQ ID NO 2. | | | | | | | | |
| 333, 334 | Plant full length insert polynucleotide seqid 4980. | ADX51636 | 0.67 | 5.1.1.1 | 939 | 312 | 0 | 377 | 58 |
| 335, 336 | *Enterobacter cloacae* protein amino acid sequence - SEQ ID 5666. | AEH54260 | 0.053 | 5.1.1.1 | 1143 | 380 | 0 | 373 | 41 |
| 337, 338 | *Bacillus licheniformis* araA gene fragment amplifying PCR primer #1. | AAD29866 | 8.00E-04 | 5.1.1.1 | 1107 | 368 | 0 | 373 | 44 |
| 339, 340 | Prokaryotic essential gene #34740. | ACA23293 | 5.00E-05 | 5.1.1.1 | 1068 | 355 | 0 | 418 | 60 |
| 341, 342 | Geranylgeranyl pyrophosphate synthase polypeptide #7. | ADM98687 | 0.046 | 5.5.1.1 | 990 | 329 | 0 | 335 | 57 |
| 343, 344 | *Streptomyces cattleya* NRRL 8057 orfY protein. | ADO51695 | 0.83 | 5.1.1.1 | 1134 | 377 | 0 | 377 | 62 |
| 345, 346 | Prokaryotic essential gene #34740. | ACA25617 | 2.2 | 5.1.1.1 | 777 | 258 | 1167 | 388 | 57 |
| 347, 348 | Plant full length insert polynucleotide seqid 4980. | ADX51636 | 0.81 | 5.1.1.1 | 1113 | 370 | 0 | 377 | 58 |
| 349, 350 | Prokaryotic essential gene #34740. | ACA42641 | 0.72 | 5.1.2.2 | 993 | 330 | 0 | 326 | 51 |
| 351, 352 | *Klebsiella pneumoniae* polypeptide seqid 7178. | ACH94858 | 5.00E-05 | 5.5.1.1 | 1005 | 334 | 0 | 354 | 52 |
| 353, 354 | Prokaryotic essential gene #34740. | ACA19650 | 3.00E-22 | 5.1.1.4 | 381 | 126 | 945 | 318 | |
| 355, 356 | Prokaryotic essential gene #34740. | ACA38093 | 9.00E-04 | 5.1.1.1 | 1155 | 384 | 0 | 360 | 39 |

TABLE 3-continued

| | | | | | | | | |
|---|---|---|---|---|---|---|---|---|
| 357, 358 | Prokaryotic essential gene #34740. | ACA40224 | 0.88 | 5.1.1.1 | 1203 | 400 | 0 | 849 | 52 |
| 359, 360 | T. versicolor pyrF PCR primer SEQ ID 5. | AAF26441 | 0.88 | 5.1.1.1 | 1203 | 400 | 0 | 849 | 52 |
| 361, 362 | T. versicolor pyrF PCR primer SEQ ID 5. | AAF26441 | 0.88 | 5.1.1.1 | 1203 | 400 | 0 | 849 | 52 |
| 363, 364 | T. versicolor pyrF PCR primer SEQ ID 5. | AAF26441 | 0.88 | 5.1.1.1 | 1203 | 400 | 0 | 849 | 52 |
| 365, 366 | T. versicolor pyrF PCR primer SEQ ID 5. | AAF26441 | 0.88 | 5.1.1.1 | 1203 | 400 | 0 | 849 | 52 |
| 367, 368 | Prokaryotic essential gene #34740. | ACA43665 | 7.00E-32 | 5.1.1.1 | 1074 | 357 | 0 | 362 | 82 |
| 369, 370 | S. lavendulae mct gene mutagenic PCR primer #2. | ADE10236 | 0.16 | 5.1.1.7 | 861 | 286 | 1413 | 285 | |
| 371, 372 | Bacterial polypeptide #10001. | ADT46187 | 2.00E-06 | 5.1.1.7 | 813 | 270 | 0 | 277 | 57 |
| 373, 374 | Environmental isolate hydrolase, SEQ ID NO: 44. | AEH47413 | 0.16 | 5.1.1.7 | 873 | 290 | 900 | 285 | |
| 375, 376 | Bacterial polypeptide #10001. | ADT42245 | 9.2 | 5.1.1.7 | 828 | 275 | 0 | 280 | 29 |
| 377, 378 | Prokaryotic essential gene #34740. | ACA27041 | 6.00E-08 | 5.1.3.14 | 1200 | 399 | 0 | 386 | 50 |
| 379, 380 | Bacterial polypeptide #10001. | ADS59825 | 3.00E-06 | 1.6.5.3 | 879 | 292 | 0 | 287 | 55 |
| 381, 382 | Bacterial polypeptide #10001. | ADS59825 | 1.00E-08 | 1.6.5.3 | 879 | 292 | 0 | 289 | 55 |
| 383, 384 | Novel canine microarray-related DNA sequence SeqID10021. | ADQ53782 | 3.1 | 5.1.2.2 | 1071 | 356 | 0 | 356 | 50 |
| 385, 386 | | | 3.4 | 5.1.1.— | 1101 | 366 | 28730 | 379 | 34 | 95 |
| 387, 388 | | | 1.00E-08 | 5.1.1.1 | 1065 | 354 | 1464 | 357 | 57 | 88 |

TABLE 3-continued

| | | | | | | | | |
|---|---|---|---|---|---|---|---|---|
| 389, 390 | | 0 | 5.1.1.1 | 1080 | 359 | 1089 | 362 | 96 | 87 |
| 391, 392 | | 0 | 5.1.1.1 | 1080 | 359 | 1089 | 362 | 96 | 87 |
| 393, 394 | | 2.00E-07 | 5.1.1.1 | 1017 | 338 | 1468 | 341 | 72 | 95 |
| 395, 396 | | 2.00E-05 | 5.1.1.1 | 1149 | 382 | 1464 | 391 | 50 | 92 |
| 397, 398 | | 0.014 | 5.1.1.1 | 1122 | 373 | 2046 | 368 | 38 | 100 |
| 399, 400 | | 0 | 5.1.1.1 | 1161 | 386 | 1227 | 409 | 96 | 92 |
| 401, 402 | | 1.00E-120 | 5.1.1.1 | 1164 | 387 | 1227 | 409 | 77 | 85 |
| 403, 404 | | 1.00E-124 | 5.1.1.1 | 1164 | 387 | 1227 | 409 | 78 | 85 |
| 405, 406 | | 0 | 5.1.1.1 | 1161 | 386 | 1227 | 409 | 97 | 96 |
| 407, 408 | | 0 | 5.1.1.1 | 1161 | 386 | 1227 | 409 | 96 | 92 |
| 409, 410 | | 0 | 5.1.1.1 | 1161 | 386 | 1227 | 409 | 96 | 92 |
| 411, 412 | | 0.077 | 5.1.1.1 | 1521 | 506 | 633 | 341 | 28 | 100 |
| 413, 414 | | 0.052 | | 1032 | 343 | 306 | 346 | 37 | 100 |
| 415, 416 | | 6.00E-05 | 5.1.1.1 | 1167 | 388 | 1227 | 386 | 61 | 83 |
| 417, 418 | | 2.00E-11 | 5.1.1.1 | 1167 | 388 | 1227 | 386 | 60 | 83 |
| 419, 420 | | 2.00E-08 | 5.1.1.1 | 1167 | 388 | 1227 | 386 | 62 | 88 |
| 421, 422 | | 7.00E-11 | 5.1.1.1 | 1167 | 388 | 1227 | 386 | 61 | 90 |
| 423, 424 | | 0 | 5.1.1.1 | 1161 | 386 | 1227 | 409 | 95 | 92 |
| 425, 426 | | 2.00E-26 | 5.1.1.1 | 1092 | 363 | 1227 | 409 | 64 | 81 |
| 427, 428 | | 1.00E-124 | 5.1.1.1 | 1230 | 409 | 1227 | 409 | 76 | 85 |
| 429, 430 | | 0 | 5.1.1.1 | 1230 | 409 | 1227 | 409 | 97 | 96 |
| 431, 432 | | 0 | 5.1.1.1 | 1161 | 386 | 1227 | 409 | 95 | 91 |
| 433, 434 | | 1.00E-124 | 5.1.1.1 | 1164 | 387 | 1227 | 409 | 78 | 85 |
| 435, 436 | | 2.00E-14 | 5.1.1.1 | 1167 | 388 | 1227 | 386 | 61 | 91 |
| 437, 438 | | 0.14 | 5.1.1.13 | 714 | 237 | 1056 | 232 | 31 | 100 |
| 439, 440 | | 6.00E-11 | 5.1.1.1 | 1095 | 364 | 1227 | 386 | 61 | 86 |
| 441, 442 | | 2.00E-14 | 5.1.1.1 | 1167 | 388 | 1227 | 386 | 61 | 91 |

TABLE 3-continued

| | | | | | | | | | |
|---|---|---|---|---|---|---|---|---|---|
| 443, 444 | | | 7.00E-14 | 5.1.1.1 | 1167 | 388 | 1227 | 386 | 61 | 81 |
| 445, 446 | | | 7.00E-11 | 5.1.1.1 | 1167 | 388 | 1227 | 386 | 59 | 86 |
| 447, 448 | | | 4.00E-06 | 5.1.1.1 | 1167 | 388 | 1227 | 386 | 61 | 83 |
| 449, 450 | | | 4.00E-06 | 5.1.1.1 | 1167 | 388 | 1227 | 386 | 61 | 83 |
| 451, 452 | | | 7.00E-11 | 5.1.1.1 | 1167 | 388 | 1227 | 386 | 62 | 86 |
| 453, 454 | | | 7.00E-11 | 5.1.1.1 | 1167 | 388 | 1227 | 386 | 61 | 86 |
| 455, 456 | | | 5.00E-11 | 5.1.1.4 | 957 | 318 | 960 | 318 | 60 | 90 |
| 457, 458 | | | 1.00E-18 | 5.1.1.4 | 1074 | 357 | 960 | 311 | 51 | 88 |
| 459, 460 | | | 1.00E-12 | 5.1.1.1 | 1167 | 388 | 1227 | 386 | 61 | 90 |
| 461, 462 | | | 4.00E-95 | 5.1.1.1 | 1092 | 363 | 1227 | 386 | 77 | 85 |
| 463, 464 | | | 0.015 | 5.1.1.1 | 1143 | 380 | 801 | 358 | 38 | 100 |
| 465, 466 | | | 3.1 | 5.1.1.4 | 1002 | 333 | 84480 | 333 | 65 | 95 |
| 467, 468 | | | 1.00E-21 | 5.1.1.4 | 960 | 319 | 945 | 331 | 60 | 91 |
| 469, 470 | | | 0.74 | 5.1.2.2 | 939 | 312 | 10118 | 347 | 50 | 93 |
| 471, 472 | | | 6.00E-45 | 5.1.1.1 | 1074 | 357 | 1071 | 357 | 78 | 82 |
| 473, 474 | | | 7.00E-11 | 5.1.1.1 | 1167 | 388 | 1227 | 386 | 62 | 86 |
| 475, 476 | | | 5.00E-95 | 5.1.1.1 | 1164 | 387 | 1227 | 386 | 76 | 85 |
| 477, 478 | | | 5.00E-27 | 5.1.1.1 | 1176 | 391 | 1227 | 409 | 63 | 81 |
| 479, 480 | Bacterial polypeptide #23667. | ADS50054 | 0.79 | | 1056 | 351 | 0 | 352 | 68 | |
| 481, 482 | *Pseudomonas putida* racemase peptide, SEQ ID 5. | ADB99538 | 6.00E-14 | 5.1.1.1 | 1089 | 362 | 0 | 408 | 83 | |
| 483, 484 | | 19172958 | 0 | 5.1.1.— | 1110 | 369 | 4E+06 | 369 | 100 | 100 |
| 485, 486 | | 16445346 | 0 | 5.1.1.— | 1089 | 362 | 2E+06 | 362 | 100 | 100 |
| 487, 488 | | 16445346 | 0 | 5.1.1.— | 1146 | 381 | 2E+06 | 397 | 100 | 100 |

The invention provides variants of polynucleotides or polypeptides of the invention, which comprise sequences modified at one or more base pairs, codons, introns, exons, or amino acid residues (respectively) yet still retain the biological activity of an isomerase, e.g., a racemase, e.g., an amino acid racemase, an alanine racemase, and/or an epimerase of the invention. Variants can be produced by any number of means included methods such as, for example, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (e.g., GeneReassembly, see, e.g., U.S. Pat. No. 6,537,776), GSSM and any combination thereof.

The term "saturation mutagenesis", "gene site saturation mutagenesis" or "GSSM" includes a method that uses degenerate oligonucleotide primers to introduce point mutations into a polynucleotide, as described in detail, below.

The term "optimized directed evolution system" or "optimized directed evolution" includes a method for reassembling fragments of related nucleic acid sequences, e.g., related genes, and explained in detail, below.

The term "synthetic ligation reassembly" or "SLR" includes a method of ligating oligonucleotide fragments in a non-stochastic fashion, and explained in detail, below.

Generating and Manipulating Nucleic Acids

The invention provides nucleic acids (e.g., nucleic acids encoding polypeptides having an isomerase activity, e.g., a racemase activity, e.g., an amino acid racemase activity, an alanine racemase activity, and/or an epimerase activity; including enzymes having at least one sequence modification of an exemplary nucleic acid sequence of the invention (as defined above), wherein the sequence modification comprises one or more nucleotide residue changes (or the equivalent thereof), including expression cassettes such as expression vectors, encoding the polypeptides of the invention.

The invention also includes methods for discovering new isomerase, e.g., racemase, e.g., amino acid racemase, alanine racemase, and/or epimerase sequences using the nucleic acids of the invention. The invention also includes methods for inhibiting the expression of isomerase, e.g., racemase, e.g., amino acid racemase, alanine racemase, and/or epimerase genes, transcripts and polypeptides using the nucleic acids of the invention. Also provided are methods for modifying the nucleic acids of the invention by, e.g., synthetic ligation reassembly, optimized directed evolution system and/or saturation mutagenesis.

The nucleic acids of the invention can be made, isolated and/or manipulated by, e.g., cloning and expression of cDNA libraries, amplification of message or genomic DNA by PCR, and the like.

In one aspect, the invention also provides an isomerase-, e.g., a racemase-, e.g., an amino acid racemase-, an alanine racemase-, and/or an epimerase-isomerase-, e.g., racemase-, e.g., amino acid racemase-, alanine racemase-, and/or epimerase-encoding nucleic acids with a common novelty in that they are derived from an environmental source, or a bacterial source, or an archaeal source.

In practicing the methods of the invention, homologous genes can be modified by manipulating a template nucleic acid, as described herein. The invention can be practiced in conjunction with any method or protocol or device known in the art, which are well described in the scientific and patent literature.

One aspect of the invention is an isolated nucleic acid comprising one of the sequences of The invention and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of a Sequence of the invention (or the sequences complementary thereto). The isolated, nucleic acids may comprise DNA, including cDNA, genomic DNA and synthetic DNA. The DNA may be double-stranded or single-stranded and if single stranded may be the coding strand or non-coding (anti-sense) strand. Alternatively, the isolated nucleic acids may comprise RNA.

Accordingly, another aspect of the invention is an isolated nucleic acid which encodes one of the polypeptides of the invention, or fragments comprising at least 5, 10, 15, 20, 25, 30, 35, 40, 50, 75, 100, or 150 consecutive amino acids of one of the polypeptides of the invention. The coding sequences of these nucleic acids may be identical to one of the coding sequences of one of the nucleic acids of the invention, or a fragment thereof or may be different coding sequences which encode one of the polypeptides of the invention, sequences substantially identical thereto and fragments having at least 5, 10, 15, 20, 25, 30, 35, 40, 50, 75, 100, or 150 consecutive amino acids of one of the polypeptides of the invention, as a result of the redundancy or degeneracy of the genetic code. The genetic code is well known to those of skill in the art and can be obtained, for example, on page 214 of B. Lewin, *Genes VI*, Oxford University Press, 1997.

The isolated nucleic acid which encodes one of the polypeptides of the invention and sequences substantially identical thereto, may include, but is not limited to: only the coding sequence of a nucleic acid of the invention and sequences substantially identical thereto and additional coding sequences, such as leader sequences or proprotein sequences and non-coding sequences, such as introns or non-coding sequences 5' and/or 3' of the coding sequence. Thus, as used herein, the term "polynucleotide encoding a polypeptide" encompasses a polynucleotide which includes only the coding sequence for the polypeptide as well as a polynucleotide which includes additional coding and/or non-coding sequence.

Alternatively, the nucleic acid sequences of the invention and sequences substantially identical thereto, may be mutagenized using conventional techniques, such as site directed mutagenesis, or other techniques familiar to those skilled in the art, to introduce silent changes into the polynucleotides of the invention and sequences substantially identical thereto. As used herein, "silent changes" include, for example, changes which do not alter the amino acid sequence encoded by the polynucleotide. Such changes may be desirable in order to increase the level of the polypeptide produced by host cells containing a vector encoding the polypeptide by introducing codons or codon pairs which occur frequently in the host organism.

The invention also relates to polynucleotides which have nucleotide changes which result in amino acid substitutions, additions, deletions, fusions and truncations in the polypeptides of the invention and sequences substantially identical thereto. Such nucleotide changes may be introduced using techniques such as site directed mutagenesis, random chemical mutagenesis, exonuclease III deletion and other recombinant DNA techniques. Alternatively, such nucleotide changes may be naturally occurring allelic variants which are isolated by identifying nucleic acids which specifically hybridize to probes comprising at least 10, 15, 20, 25, 30, 35, 40, 50, 75, 100, 150, 200, 300, 400, or 500 consecutive bases of one of the sequences of The invention and sequences substantially identical thereto (or the sequences complementary thereto) under conditions of high, moderate, or low stringency as provided herein.

General Techniques

The nucleic acids used to practice this invention, whether RNA, iRNA, antisense nucleic acid, cDNA, genomic DNA, vectors, viruses or hybrids thereof, may be isolated from a variety of sources, genetically engineered, amplified, and/or expressed/generated recombinantly. Recombinant polypeptides (e.g., isomerases, e.g., racemases, e.g., amino acid racemases, alanine racemases, and/or epimerases of the invention) generated from these nucleic acids can be individually isolated or cloned and tested for a desired activity. Any recombinant expression system can be used, including bacterial, mammalian, yeast, insect or plant cell expression systems.

Alternatively, these nucleic acids can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066.

Techniques for the manipulation of nucleic acids, such as, e.g., subcloning, labeling probes (e.g., random-primer labeling using Klenow polymerase, nick translation, amplification), sequencing, hybridization and the like are well described in the scientific and patent literature, see, e.g., Sambrook, ed., MOLECULAR CLONING: A LABORATORY MANUAL (2ND ED.), Vols. 1-3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRIDIZATION WITH NUCLEIC ACID PROBES, Part I. Theory and Nucleic Acid Preparation, Tijssen, ed. Elsevier, N.Y. (1993).

Another useful means of obtaining and manipulating nucleic acids used to practice the methods of the invention is to clone from genomic samples, and, if desired, screen and re-clone inserts isolated or amplified from, e.g., genomic clones or cDNA clones. Sources of nucleic acid used in the methods of the invention include genomic or cDNA libraries contained in, e.g., mammalian artificial chromosomes (MACs), see, e.g., U.S. Pat. Nos. 5,721,118; 6,025,155; human artificial chromosomes, see, e.g., Rosenfeld (1997) Nat. Genet. 15:333-335; yeast artificial chromosomes (YAC); bacterial artificial chromosomes (BAC); P1 artificial chromosomes, see, e.g., Woon (1998) Genomics 50:306-316; P1-derived vectors (PACs), see, e.g., Kern (1997) Biotechniques 23:120-124; cosmids, recombinant viruses, phages or plasmids.

In one aspect, a nucleic acid encoding a polypeptide of the invention is assembled in appropriate phase with a leader sequence capable of directing secretion of the translated polypeptide or fragment thereof.

The invention provides fusion proteins and nucleic acids encoding them. A polypeptide of the invention can be fused to a heterologous peptide or polypeptide, such as N-terminal identification peptides which impart desired characteristics, such as increased stability or simplified purification. Peptides and polypeptides of the invention can also be synthesized and expressed as fusion proteins with one or more additional domains linked thereto for, e.g., producing a more immunogenic peptide, to more readily isolate a recombinantly synthesized peptide, to identify and isolate antibodies and antibody-expressing B cells, and the like. Detection and purification facilitating domains include, e.g., metal chelating peptides such as polyhistidine tracts and histidine-tryptophan modules that allow purification on immobilized metals, protein A domains that allow purification on immobilized immunoglobulin, and the domain utilized in the FLAGS extension/affinity purification system (Immunex Corp, Seattle Wash.). The inclusion of a cleavable linker sequences such as Factor Xa or enterokinase (Invitrogen, San Diego Calif.) between a purification domain and the motif-comprising peptide or polypeptide to facilitate purification. For example, an expression vector can include an epitope-encoding nucleic acid sequence linked to six histidine residues followed by a thioredoxin and an enterokinase cleavage site (see e.g., Williams (1995) Biochemistry 34:1787-1797; Dobeli (1998) Protein Expr. Purif. 12:404-414). The histidine residues facilitate detection and purification while the enterokinase cleavage site provides a means for purifying the epitope from the remainder of the fusion protein. Technology pertaining to vectors encoding fusion proteins and application of fusion proteins are well described in the scientific and patent literature, see e.g., Kroll (1993) DNA Cell. Biol., 12:441-53.

The phrases "nucleic acid" or "nucleic acid sequence" as used herein refer to an oligonucleotide, nucleotide, polynucleotide, or to a fragment of any of these, to DNA or RNA of genomic or synthetic origin which may be single-stranded or double-stranded and may represent a sense or antisense strand, to peptide nucleic acid (PNA), or to any DNA-like or RNA-like material, natural or synthetic in origin. The phrases "nucleic acid" or "nucleic acid sequence" includes oligonucleotide, nucleotide, polynucleotide, or to a fragment of any of these, to DNA or RNA (e.g., mRNA, rRNA, tRNA, iRNA) of genomic or synthetic origin which may be single-stranded or double-stranded and may represent a sense or antisense strand, to peptide nucleic acid (PNA), or to any DNA-like or RNA-like material, natural or synthetic in origin, including, e.g., iRNA, ribonucleoproteins (e.g., e.g., double stranded iRNAs, e.g., iRNPs). The term encompasses nucleic acids, i.e., oligonucleotides, containing known analogues of natural nucleotides. The term also encompasses nucleic-acid-like structures with synthetic backbones, see e.g., Mata (1997) Toxicol. Appl. Pharmacol. 144:189-197; Strauss-Soukup (1997) Biochemistry 36:8692-8698; Samstag (1996) Antisense Nucleic Acid Drug Dev 6:153-156. "Oligonucleotide" includes either a single stranded polydeoxynucleotide or two complementary polydeoxynucleotide strands that may be chemically synthesized. Such synthetic oligonucleotides have no 5' phosphate and thus will not ligate to another oligonucleotide without adding a phosphate with an ATP in the presence of a kinase. A synthetic oligonucleotide can ligate to a fragment that has not been dephosphorylated.

A "coding sequence of" or a "nucleotide sequence encoding" a particular polypeptide or protein, is a nucleic acid sequence which is transcribed and translated into a polypeptide or protein when placed under the control of appropriate regulatory sequences.

The term "gene" means the segment of DNA involved in producing a polypeptide chain; it includes regions preceding and following the coding region (leader and trailer) as well as, where applicable, intervening sequences (introns) between individual coding segments (exons). "Operably linked" as used herein refers to a functional relationship between two or more nucleic acid (e.g., DNA) segments. Typically, it refers to the functional relationship of transcriptional regulatory sequence to a transcribed sequence. For example, a promoter is operably linked to a coding sequence, such as a nucleic acid of the invention, if it stimulates or modulates the transcription of the coding sequence in an appropriate host cell or other expression system. Generally, promoter transcriptional regulatory sequences that are operably linked to a transcribed sequence are physically contiguous to the transcribed sequence, i.e., they are cis-acting. However, some transcriptional regulatory sequences, such as enhancers, need not be physically contiguous or located in close proximity to the coding sequences whose transcription they enhance.

The term "expression cassette" as used herein refers to a nucleotide sequence which is capable of affecting expression of a structural gene (i.e., a protein coding sequence, such as an isomerase, e.g., racemase, e.g., amino acid racemase, alanine racemase, and/or epimerase of the invention) in a host compatible with such sequences. Expression cassettes include at least a promoter operably linked with the polypeptide coding sequence; and, in one aspect, with other sequences, e.g., transcription termination signals. Additional factors necessary or helpful in effecting expression may also be used, e.g., enhancers. Thus, expression cassettes also include plasmids, expression vectors, recombinant viruses, any form of recombinant "naked DNA" vector, and the like. A "vector" comprises a nucleic acid that can infect, transfect, transiently or permanently transduce a cell. It will be recognized that a vector can be a naked nucleic acid, or a nucleic acid complexed with protein or lipid. The vector in one aspect comprises viral or bacterial nucleic acids and/or proteins, and/or membranes (e.g., a cell membrane, a viral lipid envelope, etc.). Vectors include, but are not limited to replicons (e.g., RNA replicons, bacteriophages) to which fragments of DNA may be attached and become replicated. Vectors thus include, but are not limited to RNA, autonomous self-replicating circular or linear DNA or RNA (e.g., plasmids, viruses, and the like, see, e.g., U.S. Pat. No. 5,217,879), and include both the expression and non-expression plasmids. Where a recombinant microorganism or cell culture is described as hosting an "expression vector" this includes both extra-chromosomal circular and linear DNA and DNA that has been incorporated into the host chromosome(s). Where a vector is being maintained by a host cell, the vector may either be stably replicated by the cells during mitosis as an autonomous structure, or is incorporated within the host's genome.

As used herein, the term "promoter" includes all sequences capable of driving transcription of a coding sequence in a cell, e.g., a plant cell. Thus, promoters used in the constructs of the invention include cis-acting transcriptional control elements and regulatory sequences that are involved in regulating or modulating the timing and/or rate of transcription of a gene. For example, a promoter can be a cis-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences typically interact with proteins or other biomolecules to carry out (turn on/off, regulate, modulate, etc.) transcription. "Constitutive" promoters are those that drive expression continuously under most environmental conditions and states of development or cell differentiation. "Inducible" or "regulatable" promoters direct expression of the nucleic acid of the invention under the influence of environmental conditions or developmental conditions. Examples of environmental conditions that may affect transcription by inducible promoters include anaerobic conditions, elevated temperature, drought, or the presence of light.

"Tissue-specific" promoters are transcriptional control elements that are only active in particular cells or tissues or organs, e.g., in plants or animals. Tissue-specific regulation may be achieved by certain intrinsic factors that ensure that genes encoding proteins specific to a given tissue are expressed. Such factors are known to exist in mammals and plants so as to allow for specific tissues to develop.

As used herein, the term "isolated" means that the material (e.g., a nucleic acid, a polypeptide, a cell) is removed from its original environment (e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition and still be isolated in that such vector or composition is not part of its natural environment. As used herein, the term "purified" does not require absolute purity; rather, it is intended as a relative definition. Individual nucleic acids obtained from a library have been conventionally purified to electrophoretic homogeneity. The sequences obtained from these clones could not be obtained directly either from the library or from total human DNA. The purified nucleic acids of the invention have been purified from the remainder of the genomic DNA in the organism by at least $10^4$-$10^6$ fold. However, the term "purified" also includes nucleic acids that have been purified from the remainder of the genomic DNA or from other sequences in a library or other environment by at least one order of magnitude, typically two or three orders and more typically four or five orders of magnitude.

As used herein, the term "recombinant" means that the nucleic acid is adjacent to a "backbone" nucleic acid to which it is not adjacent in its natural environment. Additionally, to be "enriched" the nucleic acids will represent 5% or more of the number of nucleic acid inserts in a population of nucleic acid backbone molecules. Backbone molecules according to the invention include nucleic acids such as expression vectors, self-replicating nucleic acids, viruses, integrating nucleic acids and other vectors or nucleic acids used to maintain or manipulate a nucleic acid insert of interest. Typically, the enriched nucleic acids represent 15% or more of the number of nucleic acid inserts in the population of recombinant backbone molecules. More typically, the enriched nucleic acids represent 50% or more of the number of nucleic acid inserts in the population of recombinant backbone molecules. In a one aspect, the enriched nucleic acids represent 90% or more of the number of nucleic acid inserts in the population of recombinant backbone molecules.

"Plasmids" are designated by a lower case "p" preceded and/or followed by capital letters and/or numbers. The starting plasmids herein are either commercially available, publicly available on an unrestricted basis, or can be constructed from available plasmids in accord with published procedures. In addition, equivalent plasmids to those described herein are known in the art and will be apparent to the ordinarily skilled artisan. "Plasmids" can be commercially available, publicly available on an unrestricted basis, or can be constructed from available plasmids in accord with published procedures. Equivalent plasmids to those described herein are known in the art and will be apparent to the ordinarily skilled artisan.

"Digestion" of DNA refers to catalytic cleavage of the DNA with a restriction enzyme that acts only at certain sequences in the DNA. The various restriction enzymes used herein are commercially available and their reaction conditions, cofactors and other requirements were used as would be known to the ordinarily skilled artisan. For analytical purposes, typically 1 µg of plasmid or DNA fragment is used with about 2 units of enzyme in about 20 µl of buffer solution. For the purpose of isolating DNA fragments for plasmid construction, typically 5 to 50 µg of DNA are digested with 20 to 250 units of enzyme in a larger volume. Appropriate buffers and substrate amounts for particular restriction enzymes are specified by the manufacturer. Incubation times of about 1 hour at 37° C. are ordinarily used, but may vary in accordance with the supplier's instructions. After digestion, gel electrophoresis may be performed to isolate the desired fragment.

"Hybridization" refers to the process by which a nucleic acid strand joins with a complementary strand through base pairing. Hybridization reactions can be sensitive and selective so that a particular sequence of interest can be identified even in samples in which it is present at low concentrations. Suitably stringent conditions can be defined by, for example, the concentrations of salt or formamide in the prehybridization and hybridization solutions, or by the hybridization temperature and are well known in the art. In particular, stringency can be increased by reducing the concentration of salt, increasing the concentration of formamide, or raising the hybridization temperature. In alternative aspects, nucleic acids of the invention are defined by their ability to hybridize under various stringency conditions (e.g., high, medium, and low), as set forth herein.

For example, hybridization under high stringency conditions could occur in about 50% formamide at about 37° C. to 42° C. Hybridization could occur under reduced stringency conditions in about 35% to 25% formamide at about 30° C. to 35° C. In particular, hybridization could occur under high stringency conditions at 42° C. in 50% formamide, 5×SSPE, 0.3% SDS and 200 ug/ml sheared and denatured salmon sperm DNA. Hybridization could occur under reduced stringency conditions as described above, but in 35% formamide at a reduced temperature of 35° C. The temperature range corresponding to a particular level of stringency can be further narrowed by calculating the purine to pyrimidine ratio of the nucleic acid of interest and adjusting the temperature accordingly. Variations on the above ranges and conditions are well known in the art.

Transcriptional and Translational Control Sequences

The invention provides nucleic acid (e.g., DNA) sequences of the invention operatively linked to expression (e.g., transcriptional or translational) control sequence(s), e.g., promoters or enhancers, to direct or modulate RNA synthesis/expression. The expression control sequence can be in an expression vector. Exemplary bacterial promoters include lacI, lacZ, T3, T7, gpt, lambda PR, PL and trp. Exemplary eukaryotic promoters include CMV immediate early, HSV thymidine kinase, early and late SV40, LTRs from retrovirus, and mouse metallothionein I. A promoter sequence is "operably linked to" a coding sequence when RNA polymerase which initiates transcription at the promoter will transcribe the coding sequence into mRNA.

Promoters suitable for expressing a polypeptide in bacteria include the E. coli lac or trp promoters, the lad promoter, the lacZ promoter, the T3 promoter, the T7 promoter, the gpt promoter, the lambda PR promoter, the lambda PL promoter, promoters from operons encoding glycolytic enzymes such as 3-phosphoglycerate kinase (PGK), and the acid phosphatase promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used. Promoters suitable for expressing the polypeptide or fragment thereof in bacteria include the E. coli lac or trp promoters, the lad promoter, the lacZ promoter, the T3 promoter, the T7 promoter, the gpt promoter, the lambda $P_R$ promoter, the lambda $P_L$ promoter, promoters from operons encoding glycolytic enzymes such as 3-phosphoglycerate kinase (PGK) and the acid phosphatase promoter. Fungal promoters include the V factor promoter. Eukaryotic promoters include the CMV immediate early promoter, the HSV thymidine kinase promoter, heat shock promoters, the early and late SV40 promoter, LTRs from retroviruses and the mouse metallothionein-I promoter. Other promoters known to control expression of genes in prokaryotic or eukaryotic cells or their viruses may also be used.

Tissue-Specific Plant Promoters

The invention provides expression cassettes that can be expressed in a tissue-specific manner, e.g., that can express an isomerase, e.g., racemase, e.g., amino acid racemase, alanine racemase, and/or epimerase of the invention in a tissue-specific manner. The invention also provides plants or seeds that express an isomerase, e.g., racemase, e.g., amino acid racemase, alanine racemase, and/or epimerase of the invention in a tissue-specific manner. The tissue-specificity can be seed specific, stem specific, leaf specific, root specific, fruit specific and the like.

In one aspect, a constitutive promoter such as the CaMV 35S promoter can be used for expression in specific parts of the plant or seed or throughout the plant. For example, for overexpression, a plant promoter fragment can be employed which will direct expression of a nucleic acid in some or all tissues of a plant, e.g., a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of Agrobacterium tumefaciens, and other transcription initiation regions from various plant genes known to those of skill. Such genes include, e.g., ACT11 from Arabidopsis (Huang (1996) Plant Mol. Biol. 33:125-139); Cat3 from Arabidopsis (GenBank No. U43147, Zhong (1996) Mol. Gen. Genet. 251:196-203); the gene encoding stearoyl-acyl carrier protein desaturase from Brassica napus (Genbank No. X74782, Solocombe (1994) Plant Physiol. 104: 1167-1176); GPc1 from maize (GenBank No. X15596; Martinez (1989) J. Mol. Biol. 208:551-565); the Gpc2 from maize (GenBank No. U45855, Manjunath (1997) Plant Mol. Biol. 33:97-112); plant promoters described in U.S. Pat. Nos. 4,962,028; 5,633,440.

The invention uses tissue-specific or constitutive promoters derived from viruses which can include, e.g., the tobamovirus subgenomic promoter (Kumagai (1995) Proc. Natl. Acad. Sci. USA 92:1679-1683; the rice tungro bacilliform virus (RTBV), which replicates only in phloem cells in infected rice plants, with its promoter which drives strong phloem-specific reporter gene expression; the cassava vein mosaic virus (CVMV) promoter, with highest activity in vascular elements, in leaf mesophyll cells, and in root tips (Verdaguer (1996) Plant Mol. Biol. 31:1129-1139).

Alternatively, the plant promoter may direct expression of an isomerase-, e.g., a racemase-, e.g., an amino acid racemase-, an alanine racemase-, and/or an epimerase-isomerase-, e.g., racemase-, e.g., amino acid racemase-, alanine racemase-, and/or epimerase-expressing nucleic acid in a specific tissue, organ or cell type (i.e. tissue-specific promoters) or may be otherwise under more precise environmental or developmental control or under the control of an inducible promoter. Examples of environmental conditions that may affect transcription include anaerobic conditions, elevated temperature, the presence of light, or sprayed with chemicals/hormones. For example, the invention incorporates the drought-inducible promoter of maize (Busk (1997)

supra); the cold, drought, and high salt inducible promoter from potato (Kirch (1997) Plant Mol. Biol. 33:897 909).

Tissue-specific promoters can promote transcription only within a certain time frame of developmental stage within that tissue. See, e.g., Blazquez (1998) Plant Cell 10:791-800, characterizing the *Arabidopsis* LEAFY gene promoter. See also Cardon (1997) Plant J 12:367-77, describing the transcription factor SPL3, which recognizes a conserved sequence motif in the promoter region of the *A. thaliana* floral meristem identity gene AP1; and Mandel (1995) Plant Molecular Biology, Vol. 29, pp 995-1004, describing the meristem promoter eIF4. Tissue specific promoters which are active throughout the life cycle of a particular tissue can be used. In one aspect, the nucleic acids of the invention are operably linked to a promoter active primarily only in cotton fiber cells. In one aspect, the nucleic acids of the invention are operably linked to a promoter active primarily during the stages of cotton fiber cell elongation, e.g., as described by Rinehart (1996) supra. The nucleic acids can be operably linked to the Fb12A gene promoter to be preferentially expressed in cotton fiber cells (Ibid). See also, John (1997) Proc. Natl. Acad. Sci. USA 89:5769-5773; John, et al., U.S. Pat. Nos. 5,608,148 and 5,602,321, describing cotton fiber-specific promoters and methods for the construction of transgenic cotton plants. Root-specific promoters may also be used to express the nucleic acids of the invention. Examples of root-specific promoters include the promoter from the alcohol dehydrogenase gene (DeLisle (1990) Int. Rev. Cytol. 123:39-60). Other promoters that can be used to express the nucleic acids of the invention include, e.g., ovule-specific, embryo-specific, endosperm-specific, integument-specific, seed coat-specific promoters, or some combination thereof; a leaf-specific promoter (see, e.g., Busk (1997) Plant J. 11:1285 1295, describing a leaf-specific promoter in maize); the ORF13 promoter from *Agrobacterium rhizogenes* (which exhibits high activity in roots, see, e.g., Hansen (1997) supra); a maize pollen specific promoter (see, e.g., Guerrero (1990) Mol. Gen. Genet. 224:161 168); a tomato promoter active during fruit ripening, senescence and abscission of leaves and, to a lesser extent, of flowers can be used (see, e.g., Blume (1997) Plant J. 12:731 746); a pistil-specific promoter from the potato SK2 gene (see, e.g., Ficker (1997) Plant Mol. Biol. 35:425 431); the Blec4 gene from pea, which is active in epidermal tissue of vegetative and floral shoot apices of transgenic alfalfa making it a useful tool to target the expression of foreign genes to the epidermal layer of actively growing shoots or fibers; the ovule-specific BEL1 gene (see, e.g., Reiser (1995) Cell 83:735-742, GenBank No. U39944); and/or, the promoter in Klee, U.S. Pat. No. 5,589,583, describing a plant promoter region is capable of conferring high levels of transcription in meristematic tissue and/or rapidly dividing cells.

Alternatively, plant promoters which are inducible upon exposure to plant hormones, such as auxins, are used to express the nucleic acids of the invention. For example, the invention can use the auxin-response elements E1 promoter fragment (AuxREs) in the soybean (*Glycine max* L.) (Liu (1997) Plant Physiol. 115:397-407); the auxin-responsive *Arabidopsis* GST6 promoter (also responsive to salicylic acid and hydrogen peroxide) (Chen (1996) Plant J. 10: 955-966); the auxin-inducible parC promoter from tobacco (Sakai (1996) 37:906-913); a plant biotin response element (Streit (1997) Mol. Plant. Microbe Interact. 10:933-937); and, the promoter responsive to the stress hormone abscisic acid (Sheen (1996) Science 274:1900-1902).

The nucleic acids of the invention can also be operably linked to plant promoters which are inducible upon exposure to chemicals reagents which can be applied to the plant, such as herbicides or antibiotics. For example, the maize In2-2 promoter, activated by benzenesulfonamide herbicide safeners, can be used (De Veylder (1997) Plant Cell Physiol. 38:568-577); application of different herbicide safeners induces distinct gene expression patterns, including expression in the root, hydathodes, and the shoot apical meristem. Coding sequence can be under the control of, e.g., a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324). Using chemically—(e.g., hormone- or pesticide-) induced promoters, i.e., promoter responsive to a chemical which can be applied to the transgenic plant in the field, expression of a polypeptide of the invention can be induced at a particular stage of development of the plant. Thus, the invention also provides for transgenic plants containing an inducible gene encoding for polypeptides of the invention whose host range is limited to target plant species, such as corn, rice, barley, wheat, potato or other crops, inducible at any stage of development of the crop.

One of skill will recognize that a tissue-specific plant promoter may drive expression of operably linked sequences in tissues other than the target tissue. Thus, a tissue-specific promoter is one that drives expression preferentially in the target tissue or cell type, but may also lead to some expression in other tissues as well.

The nucleic acids of the invention can also be operably linked to plant promoters which are inducible upon exposure to chemicals reagents. These reagents include, e.g., herbicides, synthetic auxins, or antibiotics which can be applied, e.g., sprayed, onto transgenic plants. Inducible expression of the an isomerase-, e.g., a racemase-, e.g., an amino acid racemase-, an alanine racemase-, and/or an epimerase-isomerase-, e.g., racemase-, e.g., amino acid racemase-, alanine racemase-, and/or epimerase-producing nucleic acids of the invention will allow the grower to select plants with the optimal isomerase, e.g., racemase, e.g., amino acid racemase, alanine racemase, and/or epimerase expression and/or activity. The development of plant parts can thus controlled. In this way the invention provides the means to facilitate the harvesting of plants and plant parts. For example, in various embodiments, the maize In2-2 promoter, activated by benzenesulfonamide herbicide safeners, is used (De Veylder (1997) Plant Cell Physiol. 38:568-577); application of different herbicide safeners induces distinct gene expression patterns, including expression in the root, hydathodes, and the shoot apical meristem. Coding sequences of the invention are also under the control of a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324).

In some aspects, proper polypeptide expression may require polyadenylation region at the 3'-end of the coding region. The polyadenylation region can be derived from the natural gene, from a variety of other plant (or animal or other) genes, or from genes in the Agrobacterial T-DNA.

The term "plant" (e.g., as in a transgenic plant or plant seed of this invention, or plant promoter used in a vector of the invention) includes whole plants, plant parts (e.g., leaves, stems, flowers, roots, etc.), plant protoplasts, seeds and plant cells and progeny of same; the classes of plants that can be used to practice this invention (including compositions and methods) can be as broad as the class of higher plants, including plants amenable to transformation techniques, including angiosperms (monocotyledonous and dicotyledonous plants), as well as gymnosperms; also including plants of a variety of ploidy levels, including polyploid, diploid, haploid and hemizygous states. As used herein, the term "transgenic plant" includes plants or plant cells into which a heterologous nucleic acid sequence has been inserted, e.g., the nucleic acids and various recombinant constructs (e.g., expression cassettes, such a vectors) of the invention. Transgenic plants of the invention are also discussed, below.

Expression Vectors and Cloning Vehicles

The invention provides expression vectors and cloning vehicles comprising nucleic acids of the invention, e.g., sequences encoding the isomerases, e.g., racemases, e.g., amino acid racemases, alanine racemases, and/or epimerases of the invention. Expression vectors and cloning vehicles of the invention can comprise viral particles, baculovirus, phage, plasmids, phagemids, cosmids, fosmids, bacterial artificial chromosomes, viral DNA (e.g., vaccinia, adenovirus, foul pox virus, pseudorabies and derivatives of SV40), P1-based artificial chromosomes, yeast plasmids, yeast artificial chromosomes, and any other vectors specific for specific hosts of interest (such as bacillus, Aspergillus and yeast). Vectors of the invention can include chromosomal, non-chromosomal and synthetic DNA sequences. Large numbers of suitable vectors are known to those of skill in the art, and are commercially available. Exemplary vectors are include: bacterial: pQE vectors (Qiagen), pBluescript plasmids, pNH vectors, (lambda-ZAP vectors (Stratagene); ptrc99a, pKK223-3, pDR540, pRIT2T (Pharmacia); Eukaryotic: pXT1, pSG5 (Stratagene), pSVK3, pBPV, pMSG, pSVLSV40 (Pharmacia). However, any other plasmid or other vector may be used so long as they are replicable and viable in the host. Low copy number or high copy number vectors may be employed with the present invention.

The expression vector can comprise a promoter, a ribosome binding site for translation initiation and a transcription terminator. The vector may also include appropriate sequences for amplifying expression. Mammalian expression vectors can comprise an origin of replication, any necessary ribosome binding sites, a polyadenylation site, splice donor and acceptor sites, transcriptional termination sequences, and 5' flanking non-transcribed sequences. In some aspects, DNA sequences derived from the SV40 splice and polyadenylation sites may be used to provide the required non-transcribed genetic elements.

In one aspect, the expression vectors contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in E. coli, and the S. cerevisiae TRP1 gene. Promoter regions can be selected from any desired gene using chloramphenicol transferase (CAT) vectors or other vectors with selectable markers.

Vectors for expressing the polypeptide or fragment thereof in eukaryotic cells can also contain enhancers to increase expression levels. Enhancers are cis-acting elements of DNA, usually from about 10 to about 300 bp in length that act on a promoter to increase its transcription. Examples include the SV40 enhancer on the late side of the replication origin by 100 to 270, the cytomegalovirus early promoter enhancer, the polyoma enhancer on the late side of the replication origin, and the adenovirus enhancers.

A nucleic acid sequence can be inserted into a vector by a variety of procedures. In general, the sequence is ligated to the desired position in the vector following digestion of the insert and the vector with appropriate restriction endonucleases. Alternatively, blunt ends in both the insert and the vector may be ligated. A variety of cloning techniques are known in the art, e.g., as described in Ausubel and Sambrook. Such procedures and others are deemed to be within the scope of those skilled in the art.

The vector can be in the form of a plasmid, a viral particle, or a phage. Other vectors include chromosomal, non-chromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by, e.g., Sambrook.

Particular bacterial vectors which can be used include the commercially available plasmids comprising genetic elements of the well known cloning vector pBR322 (ATCC 37017), pKK223-3 (Pharmacia Fine Chemicals, Uppsala, Sweden), GEM1 (Promega Biotec, Madison, Wis., USA) pQE70, pQE60, pQE-9 (Qiagen), pD10, psiX174 pBluescript II KS, pNH8A, pNH16a, pNH18A, pNH46A (Stratagene), ptrc99a, pKK223-3, pKK233-3, DR540, pRIT5 (Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and viable in the host cell.

The nucleic acids of the invention can be expressed in expression cassettes, vectors or viruses and transiently or stably expressed in plant cells and seeds. One exemplary transient expression system uses episomal expression systems, e.g., cauliflower mosaic virus (CaMV) viral RNA generated in the nucleus by transcription of an episomal mini-chromosome containing supercoiled DNA, see, e.g., Covey (1990) Proc. Natl. Acad. Sci. USA 87:1633-1637. Alternatively, coding sequences, i.e., all or sub-fragments of sequences of the invention can be inserted into a plant host cell genome becoming an integral part of the host chromosomal DNA. Sense or antisense transcripts can be expressed in this manner. A vector comprising the sequences (e.g., promoters or coding regions) from nucleic acids of the invention can comprise a marker gene that confers a selectable phenotype on a plant cell or a seed. For example, the marker may encode biocide resistance, particularly antibiotic resistance, such as resistance to kanamycin, G418, bleomycin, hygromycin, or herbicide resistance, such as resistance to chlorosulfuron or Basta.

Expression vectors capable of expressing nucleic acids and proteins in plants are well known in the art, and can include, e.g., vectors from Agrobacterium spp., potato virus X (see, e.g., Angell (1997) EMBO J. 16:3675-3684), tobacco mosaic virus (see, e.g., Casper (1996) Gene 173:69-73), tomato bushy stunt virus (see, e.g., Hillman (1989) Virology 169:42-50), tobacco etch virus (see, e.g., Dolja (1997) Virology 234: 243-252), bean golden mosaic virus (see, e.g., Morinaga (1993) Microbiol Immunol. 37:471-476), cauliflower mosaic virus (see, e.g., Cecchini (1997) Mol. Plant. Microbe Interact. 10:1094-1101), maize Ac/Ds transposable element (see, e.g., Rubin (1997) Mol. Cell. Biol. 17:6294-6302; Kunze (1996) Curr. Top. Microbiol. Immunol. 204:161-194), and the maize suppressor-mutator (Spm) transposable element (see, e.g., Schlappi (1996) Plant Mol. Biol. 32:717-725); and derivatives thereof.

In one aspect, the expression vector can have two replication systems to allow it to be maintained in two organisms, for example in mammalian or insect cells for expression and in a prokaryotic host for cloning and amplification. Furthermore, for integrating expression vectors, the expression vector can contain at least one sequence homologous to the host cell genome. It can contain two homologous sequences which flank the expression construct. The integrating vector can be directed to a specific locus in the host cell by selecting the appropriate homologous sequence for inclusion in the vector. Constructs for integrating vectors are well known in the art.

Expression vectors of the invention may also include a selectable marker gene to allow for the selection of bacterial strains that have been transformed, e.g., genes which render the bacteria resistant to drugs such as ampicillin, chloramphenicol, erythromycin, kanamycin, neomycin and tetracycline. Selectable markers can also include biosynthetic genes, such as those in the histidine, tryptophan and leucine biosynthetic pathways.

The DNA sequence in the expression vector is operatively linked to an appropriate expression control sequence(s) (promoter) to direct RNA synthesis. Particular named bacterial promoters include lacI, lacZ, T3, T7, gpt, lambda $P_R$, $F_L$ and trp. Eukaryotic promoters include CMV immediate early, HSV thymidine kinase, early and late SV40, LTRs from retrovirus and mouse metallothionein-I. Selection of the appropriate vector and promoter is well within the level of ordinary skill in the art. The expression vector also contains a ribosome binding site for translation initiation and a transcription terminator. The vector may also include appropriate sequences for amplifying expression. Promoter regions can be selected from any desired gene using chloramphenicol transferase (CAT) vectors or other vectors with selectable markers. In addition, the expression vectors preferably contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Mammalian expression vectors may also comprise an origin of replication, any necessary ribosome binding sites, a polyadenylation site, splice donor and acceptor sites, transcriptional termination sequences and 5' flanking nontranscribed sequences. In some aspects, DNA sequences derived from the SV40 splice and polyadenylation sites may be used to provide the required nontranscribed genetic elements.

Vectors for expressing the polypeptide or fragment thereof in eukaryotic cells may also contain enhancers to increase expression levels. Enhancers are cis-acting elements of DNA, usually from about 10 to about 300 bp in length that act on a promoter to increase its transcription. Examples include the SV40 enhancer on the late side of the replication origin by 100 to 270, the cytomegalovirus early promoter enhancer, the polyoma enhancer on the late side of the replication origin and the adenovirus enhancers.

In addition, the expression vectors typically contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli* and the *S. cerevisiae* TRP1 gene.

In some aspects, the nucleic acid encoding one of the polypeptides of the invention and sequences substantially identical thereto, or fragments comprising at least about 5, 10, 15, 20, 25, 30, 35, 40, 50, 75, 100, or 150 consecutive amino acids thereof is assembled in appropriate phase with a leader sequence capable of directing secretion of the translated polypeptide or fragment thereof. The nucleic acid can encode a fusion polypeptide in which one of the polypeptides of the invention and sequences substantially identical thereto, or fragments comprising at least 5, 10, 15, 20, 25, 30, 35, 40, 50, 75, 100, or 150 consecutive amino acids thereof is fused to heterologous peptides or polypeptides, such as N-terminal identification peptides which impart desired characteristics, such as increased stability or simplified purification.

The appropriate DNA sequence may be inserted into the vector by a variety of procedures. In general, the DNA sequence is ligated to the desired position in the vector following digestion of the insert and the vector with appropriate restriction endonucleases.

Alternatively, blunt ends in both the insert and the vector may be ligated. A variety of cloning techniques are disclosed in Ausubel et al. Current Protocols in Molecular Biology, John Wiley 503 Sons, Inc. 1997 and Sambrook et al., *Molecular Cloning: A Laboratory Manual* 2nd Ed., Cold Spring Harbor Laboratory Press (1989. Such procedures and others are deemed to be within the scope of those skilled in the art.

The vector may be, for example, in the form of a plasmid, a viral particle, or a phage. Other vectors include chromosomal, nonchromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus and pseudorabies. A variety of cloning and expression vectors for use with prokaryotic and eukaryotic hosts are described by Sambrook, et al., *Molecular Cloning: A Laboratory Manual, 2nd Ed.*, Cold Spring Harbor, N.Y., (1989).

Host Cells and Transformed Cells

The invention also provides transformed cells comprising a nucleic acid sequence of the invention, e.g., a sequence encoding an isomerase, e.g., a racemase, e.g., an amino acid racemase, an alanine racemase, and/or an epimerase of the invention, or a vector of the invention. The host cell may be any of the host cells familiar to those skilled in the art, including prokaryotic cells, eukaryotic cells, such as bacterial cells, fungal cells, yeast cells, mammalian cells, insect cells, or plant cells. Exemplary bacterial cells include any species within the genera *Escherichia, Bacillus, Streptomyces, Salmonella, Pseudomonas* and *Staphylococcus*, including, e.g., *Escherichia coli, Lactococcus lactis, Bacillus subtilis, Bacillus cereus, Salmonella typhimurium, Pseudomonas fluorescens*. Exemplary fungal cells include any species of *Aspergillus*. Exemplary yeast cells include any species of *Pichia, Saccharomyces, Schizosaccharomyces,* or *Schwanniomyces*, including *Pichia pastoris, Saccharomyces cerevisiae*, or *Schizosaccharomyces pombe*. Exemplary insect cells include any species of *Spodoptera* or *Drosophila*, including *Drosophila* S2 and *Spodoptera* Sf9. Exemplary animal cells include CHO, COS or Bowes melanoma or any mouse or human cell line. The selection of an appropriate host is within the abilities of those skilled in the art. Techniques for transforming a wide variety of higher plant species are well known and described in the technical and scientific literature. See, e.g., Weising (1988) Ann. Rev. Genet. 22:421-477; U.S. Pat. No. 5,750,870.

The vector can be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

In one aspect, the nucleic acids or vectors of the invention are introduced into the cells for screening, thus, the nucleic acids enter the cells in a manner suitable for subsequent expression of the nucleic acid. The method of introduction is largely dictated by the targeted cell type. Exemplary methods include CaPO$_4$ precipitation, liposome fusion, lipofection (e.g., LIPOFECTIN™), electroporation, viral infection, etc. The candidate nucleic acids may stably integrate into the genome of the host cell (for example, with retroviral introduction) or may exist either transiently or stably in the cytoplasm (i.e. through the use of traditional plasmids, utilizing standard regulatory sequences, selection markers, etc.). As many pharmaceutically important screens require human or model mammalian cell targets, retroviral vectors capable of transfecting such targets are can be used.

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells can be harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Cell-free translation systems can also be employed to produce a polypeptide of the invention. Cell-free translation systems can use mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

The expression vectors can contain one or more selectable marker genes to provide a phenotypic trait for selection of transformed host cells such as dihydrofolate reductase or neomycin resistance for eukaryotic cell culture, or such as tetracycline or ampicillin resistance in *E. coli.*

Host cells containing the polynucleotides of interest, e.g., nucleic acids of the invention, can be cultured in conventional nutrient media modified as appropriate for activating promoters, selecting transformants or amplifying genes. The culture conditions, such as temperature, pH and the like, are those previously used with the host cell selected for expression and will be apparent to the ordinarily skilled artisan. The clones which are identified as having the specified enzyme activity may then be sequenced to identify the polynucleotide sequence encoding an enzyme having the enhanced activity.

The invention provides a method for overexpressing a recombinant isomerase, e.g., racemase, e.g., amino acid racemase, alanine racemase, and/or epimerase in a cell comprising expressing a vector comprising a nucleic acid of the invention, e.g., a nucleic acid comprising a nucleic acid sequence with at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a sequence of the invention over a region of at least about 100 residues, wherein the sequence identities are determined by analysis with a sequence comparison algorithm or by visual inspection, or, a nucleic acid that hybridizes under stringent conditions to a nucleic acid sequence of the invention, or a subsequence thereof. The overexpression can be effected by any means, e.g., use of a high activity promoter, a dicistronic vector or by gene amplification of the vector.

The nucleic acids of the invention can be expressed, or overexpressed, in any in vitro or in vivo expression system. Any cell culture systems can be employed to express, or over-express, recombinant protein, including bacterial, insect, yeast, fungal or mammalian cultures. Over-expression can be effected by appropriate choice of promoters, enhancers, vectors (e.g., use of replicon vectors, dicistronic vectors (see, e.g., Gurtu (1996) Biochem. Biophys. Res. Commun. 229:295-8), media, culture systems and the like. In one aspect, gene amplification using selection markers, e.g., glutamine synthetase (see, e.g., Sanders (1987) Dev. Biol. Stand. 66:55-63), in cell systems are used to overexpress the polypeptides of the invention.

Additional details regarding this approach are in the public literature and/or are known to the skilled artisan. In a particular non-limiting exemplification, such publicly available literature includes, for example: Appl Environ Microbiol. 2004 June; 70(6):3298-304; *Biotechnol Bioeng.* 2007 Nov. 1; 98(4):812-24 and *FEMS Microbiol Lett.* 2001 Mar. 15; 196 (2):93-8, although these references do not teach the inventive enzymes of the instant application.

The host cell may be any of the host cells familiar to those skilled in the art, including prokaryotic cells, eukaryotic cells, mammalian cells, insect cells, or plant cells. As representative examples of appropriate hosts, there may be mentioned: bacterial cells, such as *E. coli, Streptomyces, Bacillus subtilis, Bacillus cereus, Salmonella typhimurium* and various species within the genera *Pseudomonas, Streptomyces* and *Staphylococcus,* fungal cells, such as *Aspergillus,* yeast such as any species of *Pichia, Saccharomyces, Schizosaccharomyces, Schwanniomyces,* including *Pichia pastoris, Saccharomyces cerevisiae,* or *Schizosaccharomyces pombe,* insect cells such as *Drosophila* S2 and *Spodoptera* Sf9, animal cells such as CHO, COS or Bowes melanoma and adenoviruses. The selection of an appropriate host is within the abilities of those skilled in the art.

The vector may be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells are typically harvested by centrifugation, disrupted by physical or chemical means and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts (described by Gluzman, Cell, 23:175, 1981) and other cell lines capable of expressing proteins from a compatible vector, such as the C127, 3T3, CHO, HeLa and BHK cell lines.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Alternatively, the polypeptides of amino acid sequences of the invention, or fragments comprising at least 5, 10, 15, 20, 25, 30, 35, 40, 50, 75, 100, or 150 consecutive amino acids thereof can be synthetically produced by conventional peptide synthesizers. In other aspects, fragments or portions of the polypeptides may be employed for producing the corresponding full-length polypeptide by peptide synthesis; therefore, the fragments may be employed as intermediates for producing the full-length polypeptides.

Cell-free translation systems can also be employed to produce one of the polypeptides of amino acid sequences of the invention, or fragments comprising at least 5, 10, 15, 20, 25, 30, 35, 40, 50, 75, 100, or 150 consecutive amino acids thereof using mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

Amplification of Nucleic Acids

In practicing the invention, nucleic acids of the invention and nucleic acids encoding the isomerases, e.g., racemases, e.g., amino acid racemases, alanine racemases, and/or epimerases of the invention, or modified nucleic acids of the invention, can be reproduced by amplification. Amplification can also be used to clone or modify the nucleic acids of the invention. Thus, the invention provides amplification primer sequence pairs for amplifying nucleic acids of the invention. One of skill in the art can design amplification primer sequence pairs for any part of or the full length of these sequences.

In one aspect, the invention provides a nucleic acid amplified by a primer pair of the invention, e.g., a primer pair as set forth by about the first (the 5') 12, 13, 14, 15, 16, 17, 18, 19, 20, 21, 22, 23, 24, or 25 residues of a nucleic acid of the invention, and about the first (the 5') 15, 16, 17, 18, 19, 20, 21, 22, 23, 24, or 25 residues of the complementary strand.

The invention provides an amplification primer sequence pair for amplifying a nucleic acid encoding a polypeptide having an isomerase, e.g., racemase, e.g., amino acid racemase, alanine racemase, and/or epimerase activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50 consecutive bases of the sequence, or about 12, 13, 14, 15, 16, 17, 18, 19, 20, 21, 22, 23, 24, or 25 consecutive bases of the sequence. The invention provides amplification primer pairs, wherein the primer pair comprises a first member having a sequence as set forth by about the first (the 5') 12, 13, 14, 15, 16, 17, 18, 19, 20, 21, 22, 23, 24, or 25 residues of a nucleic acid of the invention, and a second member having a sequence as set forth by about the first (the 5') 12, 13, 14, 15, 16, 17, 18, 19, 20, 21, 22, 23, 24, or 25 residues of the complementary strand of the first member. The invention provides isomerases, e.g., racemases, e.g., amino acid racemases, alanine racemases, and/or epimerases generated by amplification, e.g., polymerase chain reaction (PCR), using an amplification primer pair of the invention. The invention provides methods of making an isomerase, e.g., racemase, e.g., amino acid racemase, alanine racemase, and/or epimerase by amplification, e.g., polymerase chain reaction (PCR), using an amplification primer pair of the invention. In one aspect, the amplification primer pair amplifies a nucleic acid from a library, e.g., a gene library, such as an environmental library.

Amplification reactions can also be used to quantify the amount of nucleic acid in a sample (such as the amount of message in a cell sample), label the nucleic acid (e.g., to apply it to an array or a blot), detect the nucleic acid, or quantify the amount of a specific nucleic acid in a sample. In one aspect of the invention, message isolated from a cell or a cDNA library are amplified.

The skilled artisan can select and design suitable oligonucleotide amplification primers. Amplification methods are also well known in the art, and include, e.g., polymerase chain reaction, PCR (see, e.g., PCR PROTOCOLS, A GUIDE TO METHODS AND APPLICATIONS, ed. Innis, Academic Press, N.Y. (1990) and PCR STRATEGIES (1995), ed. Innis, Academic Press, Inc., N.Y., ligase chain reaction (LCR) (see, e.g., Wu (1989) Genomics 4:560; Landegren (1988) Science 241:1077; Barringer (1990) Gene 89:117); transcription amplification (see, e.g., Kwoh (1989) Proc. Natl. Acad. Sci. USA 86:1173); and, self-sustained sequence replication (see, e.g., Guatelli (1990) Proc. Natl. Acad. Sci. USA 87:1874); Q Beta replicase amplification (see, e.g., Smith (1997) J. Clin. Microbiol. 35:1477-1491), automated Q-beta replicase amplification assay (see, e.g., Burg (1996) Mol. Cell. Probes 10:257-271) and other RNA polymerase mediated techniques (e.g., NASBA, Cangene, Mississauga, Ontario); see also Berger (1987) Methods Enzymol. 152:307-316; Sambrook;

Ausubel; U.S. Pat. Nos. 4,683,195 and 4,683,202; Sooknanan (1995) Biotechnology 13:563-564.

Determining the Degree of Sequence Identity

The invention provides nucleic acids comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention (as defined above) over a region of at least about 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues. The invention provides polypeptides comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide of the invention. The extent of sequence identity (homology) may be determined using any computer program and associated parameters, including those described herein, such as BLAST 2.2.2. or FASTA version 3.0t78, with the default parameters.

As used herein, the terms "computer," "computer program" and "processor" are used in their broadest general contexts and incorporate all such devices, as described in detail, below. A "coding sequence of" or a "sequence encodes" a particular polypeptide or protein, is a nucleic acid sequence which is transcribed and translated into a polypeptide or protein when placed under the control of appropriate regulatory sequences.

The phrase "substantially identical" in the context of two nucleic acids or polypeptides, refers to two or more sequences that have, e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more nucleotide or amino acid residue (sequence) identity, when compared and aligned for maximum correspondence, as measured using one of the known sequence comparison algorithms or by visual inspection. Typically, the substantial identity exists over a region of at least about 100 residues and most commonly the sequences are substantially identical over at least about 150-200 residues. In some aspects, the sequences are substantially identical over the entire length of the coding regions.

Additionally a "substantially identical" amino acid sequence is a sequence that differs from a reference sequence by one or more conservative or non-conservative amino acid substitutions, deletions, or insertions, particularly when such a substitution occurs at a site that is not the active site of the molecule and provided that the polypeptide essentially retains its functional properties. A conservative amino acid substitution, for example, substitutes one amino acid for another of the same class (e.g., substitution of one hydrophobic amino acid, such as isoleucine, valine, leucine, or methionine, for another, or substitution of one polar amino acid for another, such as substitution of arginine for lysine, glutamic acid for aspartic acid or glutamine for asparagine). One or more amino acids can be deleted, for example, from an isomerase, e.g., racemase, e.g., amino acid racemase, alanine racemase, and/or epimerase polypeptide, resulting in modification of the structure of the polypeptide, without significantly altering its biological activity. For example, amino- or carboxyl-terminal amino acids that are not required for isomerase, e.g., racemase, e.g., amino acid racemase, alanine racemase, and/or epimerase biological activity can be removed. Modified polypeptide sequences of the invention can be assayed for isomerase, e.g., racemase, e.g., amino acid racemase, alanine racemase, and/or epimerase biological activity by any number of methods, including contacting the modified polypeptide sequence with an isomerase, e.g., racemase, e.g., amino acid racemase, alanine racemase, and/or epimerase substrate and determining whether the modified polypeptide decreases the amount of specific substrate in the assay or increases the bioproducts of the enzymatic reaction of a functional isomerase, e.g., racemase, e.g., amino acid racemase, alanine racemase, and/or epimerase polypeptide with the substrate.

Nucleic acid sequences of the invention can comprise at least 10, 15, 20, 25, 30, 35, 40, 50, 75, 100, 150, 200, 300, 400, or 500 consecutive nucleotides of an exemplary sequence of the invention and sequences substantially identical thereto. Nucleic acid sequences of the invention can comprise homologous sequences and fragments of nucleic acid sequences and sequences substantially identical thereto, refer to a sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity (homology) to these sequences. Homology may be determined using any of the computer programs and parameters described herein, including FASTA version 3.0t78 with the default parameters. Homologous sequences also include RNA sequences in which uridines replace the thymines in the nucleic acid sequences of the invention. The homologous sequences may be obtained using any of the procedures described herein or may result from the correction of a sequencing error. It will be appreciated that the nucleic acid sequences of the invention and sequences substantially identical thereto, can be represented in the traditional single character format (See the inside back cover of Stryer, Lubert. Biochemistry, 3rd Ed., W. H Freeman & Co., New York.) or in any other format which records the identity of the nucleotides in a sequence.

Various sequence comparison programs identified elsewhere in this patent specification are particularly contemplated for use in this aspect of the invention. Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA and CLUSTALW (Pearson and Lipman, Proc. Natl. Acad. Sci. USA 85(8):2444-2448, 1988; Altschul et al., J. Mol. Biol. 215(3):403-410, 1990; Thompson et al., Nucleic Acids Res. 22(2):4673-4680, 1994; Higgins et al., Methods Enzymol. 266:383-402, 1996; Altschul et al., J. Mol. Biol. 215(3):403-410, 1990; Altschul et al., Nature Genetics 3:266-272, 1993).

Homology or identity is often measured using sequence analysis software (e.g., Sequence Analysis Software Package of the Genetics Computer Group, University of Wisconsin Biotechnology Center, 1710 University Avenue, Madison, Wis. 53705). Such software matches similar sequences by assigning degrees of homology to various deletions, substitutions and other modifications. The terms "homology" and "identity" in the context of two or more nucleic acids or polypeptide sequences, refer to two or more sequences or subsequences that are the same or have a specified percentage of amino acid residues or nucleotides that are the same when compared and aligned for maximum correspondence over a comparison window or designated region as measured using any number of sequence comparison algorithms or by manual alignment and visual inspection.

For sequence comparison, typically one sequence acts as a reference sequence, to which test sequences are compared. When using a sequence comparison algorithm, test and reference sequences are entered into a computer, subsequence coordinates are designated, if necessary and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequence for comparison are well-known in the art. Optimal alignment of sequences for comparison can be conducted, e.g., by the local homology algorithm of Smith & Waterman, Adv. Appl. Math. 2:482, 1981, by the homology alignment algorithm of Needleman & Wunsch, J. Mol. Biol 48:443, 1970, by the search for similarity method of person & Lipman, Proc. Nat'l. Acad. Sci. USA 85:2444, 1988, by computerized implementations of these algorithms (GAP, BEST-FIT, FASTA and TFASTA in the Wisconsin Genetics Software Package, Genetics Computer Group, 575 Science Dr., Madison, Wis.), or by manual alignment and visual inspection. Other algorithms for determining homology or identity include, for example, in addition to a BLAST program (Basic Local Alignment Search Tool at the National Center for Biological Information), ALIGN, AMAS (Analysis of Multiply Aligned Sequences), AMPS (Protein Multiple Sequence Alignment), ASSET (Aligned Segment Statistical Evaluation Tool), BANDS, BESTSCOR, BIOSCAN (Biological Sequence Comparative Analysis Node), BLIMPS (BLocks IMProved Searcher), FASTA, Intervals & Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction & Analysis Workbench), MAP (Multiple Alignment Program), MBLKP, MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences. A number of genome databases are available, for example, a substantial portion of the human genome is available as part of the Human Genome Sequencing Project. At least twenty-one other genomes have already been sequenced, including, for example, *M. genitalium* (Fraser et al., 1995), *M. jannaschii* (Bult et al., 1996), *H. influenzae* (Fleischmann et al., 1995), *E. coli* (Blattner et al., 1997) and yeast (*S. cerevisiae*) (Mewes et al., 1997) and *D. melanogaster* (Adams et al., 2000). Significant progress has also been made in sequencing the genomes of model organism, such as mouse, *C. elegans* and *Arabadopsis* sp. Several databases containing genomic information annotated with some functional information are maintained by different organization and are accessible via the internet One example of a useful algorithm is BLAST and BLAST 2.0 algorithms, which are described in Altschul et al., Nuc. Acids Res. 25:3389-3402, 1977 and Altschul et al., J. Mol. Biol. 215:403-410, 1990, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, an expectation (E) of 10, M=5, N=-4 and a comparison of both strands. For amino acid sequences, the BLASTP program uses as defaults a wordlength of 3 and expectations (E) of 10 and the BLOSUM62 scoring matrix (see Henikoff & Henikoff, Proc. Natl. Acad. Sci. USA 89:10915, 1989) alignments (B) of 50, expectation (E) of 10, M=5, N=-4 and a comparison of both strands.

The BLAST algorithm also performs a statistical analysis of the similarity between two sequences (see, e.g., Karlin & Altschul, Proc. Natl. Acad. Sci. USA 90:5873, 1993). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, more preferably less than about 0.01 and most preferably less than about 0.001.

In one aspect, protein and nucleic acid sequence homologies are evaluated using the Basic Local Alignment Search Tool ("BLAST") In particular, five specific BLAST programs are used to perform the following task:

(1) BLASTP and BLAST3 compare an amino acid query sequence against a protein sequence database;
(2) BLASTN compares a nucleotide query sequence against a nucleotide sequence database;
(3) BLASTX compares the six-frame conceptual translation products of a query nucleotide sequence (both strands) against a protein sequence database;
(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., Science 256:1443-1445, 1992; Henikoff and Henikoff, Proteins 17:49-61, 1993). Less preferably, the PAM or PAM250 matrices may also be used (see, e.g., Schwartz and Dayhoff, eds., 1978, *Matrices for Detecting Distance Relationships: Atlas of Protein Sequence and Structure*, Washington: National Biomedical Research Foundation). BLAST programs are accessible through the U.S. National Library of Medicine.

The parameters used with the above algorithms may be adapted depending on the sequence length and degree of homology studied. In some aspects, the parameters may be the default parameters used by the algorithms in the absence of instructions from the user.

Computer Systems and Computer Program Products

To determine and identify sequence identities, structural homologies, motifs and the like in silico, a nucleic acid or polypeptide sequence of the invention can be stored, recorded, and manipulated on any medium which can be read and accessed by a computer.

Accordingly, the invention provides computers, computer systems, computer readable mediums, computer programs products and the like recorded or stored thereon the nucleic acid and polypeptide sequences of the invention. As used herein, the words "recorded" and "stored" refer to a process for storing information on a computer medium. A skilled artisan can readily adopt any known methods for recording information on a computer readable medium to generate manufactures comprising one or more of the nucleic acid and/or polypeptide sequences of the invention.

The polypeptides of the invention include the exemplary sequences of the invention, and sequences substantially identical thereto, and fragments of any of the preceding sequences. Substantially identical, or homologous, polypeptide sequences refer to a polypeptide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary sequence of the invention, e.g., a polypeptide sequences of the invention.

Homology may be determined using any of the computer programs and parameters described herein, including FASTA version 3.0t78 with the default parameters or with any modified parameters. The homologous sequences may be obtained using any of the procedures described herein or may result from the correction of a sequencing error. The polypeptide fragments comprise at least about 10, 15, 20, 25, 30, 35, 40, 45, 50, 75, 100, 150, 200, 250, 300, 350, 400, 450, 500 or more consecutive amino acids of the polypeptides of the invention and sequences substantially identical thereto. It will be appreciated that the polypeptide codes of amino acid sequences of the invention and sequences substantially identical thereto, can be represented in the traditional single character format or three letter format (See Stryer, Lubert. *Biochemistry, 3rd Ed.*, supra) or in any other format which relates the identity of the polypeptides in a sequence.

A nucleic acid or polypeptide sequence of the invention can be stored, recorded and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid sequences of the invention and sequences substantially identical thereto, one or more of the polypeptide sequences of the invention and sequences substantially identical thereto. Another aspect of the invention is a computer readable medium having recorded thereon at least 2, 5, 10, 15, or 20 or more nucleic acid sequences of the invention and sequences substantially identical thereto.

Another aspect of the invention is a computer readable medium having recorded thereon one or more of the nucleic acid sequences of the invention and sequences substantially identical thereto. Another aspect of the invention is a computer readable medium having recorded thereon one or more of the polypeptide sequences of the invention and sequences substantially identical thereto. Another aspect of the invention is a computer readable medium having recorded thereon at least 2, 5, 10, 15, or 20 or more of the sequences as set forth above.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Aspects of the invention include systems (e.g., interne based systems), particularly computer systems which store and manipulate the sequence information described herein. One example of a computer system 100 is illustrated in block diagram form in FIG. 1. As used herein, "a computer system" refers to the hardware components, software components and data storage components used to analyze a nucleotide sequence of a nucleic acid sequence of the invention and sequences substantially identical thereto, or a polypeptide sequence as set forth in the amino acid sequences of the invention. The computer system 100 typically includes a processor for processing, accessing and manipulating the sequence data. The processor 105 can be any well-known type of central processing unit, such as, for example, the Pentium III from Intel Corporation, or similar processor from Sun, Motorola, Compaq, AMD or International Business Machines.

Typically the computer system 100 is a general purpose system that comprises the processor 105 and one or more internal data storage components 110 for storing data and one or more data retrieving devices for retrieving the data stored on the data storage components. A skilled artisan can readily appreciate that any one of the currently available computer systems are suitable.

In one particular aspect, the computer system 100 includes a processor 105 connected to a bus which is connected to a main memory 115 (preferably implemented as RAM) and one or more internal data storage devices 110, such as a hard drive and/or other computer readable media having data recorded thereon. In some aspects, the computer system 100 further includes one or more data retrieving device 118 for reading the data stored on the internal data storage devices 110.

The data retrieving device 118 may represent, for example, a floppy disk drive, a compact disk drive, a magnetic tape drive, or a modem capable of connection to a remote data storage system (e.g., via the internet) etc. In some aspects, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125*a-c* in a network or wide area network to provide centralized access to the computer system 100.

Software for accessing and processing the nucleotide sequences of a nucleic acid sequence of the invention and sequences substantially identical thereto, or a polypeptide sequence of the invention and sequences substantially identical thereto, (such as search tools, compare tools and modeling tools etc.) may reside in main memory 115 during execution.

In some aspects, the computer system 100 may further comprise a sequence comparison algorithm for comparing a nucleic acid sequence of the invention and sequences substantially identical thereto, or a polypeptide sequence of the invention and sequences substantially identical thereto, stored on a computer readable medium to a reference nucleotide or polypeptide sequence(s) stored on a computer readable medium. A "sequence comparison algorithm" refers to one or more programs which are implemented (locally or remotely) on the computer system 100 to compare a nucleotide sequence with other nucleotide sequences and/or compounds stored within a data storage means. For example, the sequence comparison algorithm may compare the nucleotide sequences of a nucleic acid sequence of the invention and sequences substantially identical thereto, or a polypeptide sequence of the invention and sequences substantially identical thereto, stored on a computer readable medium to reference sequences stored on a computer readable medium to identify homologies or structural motifs.

Figure 2:
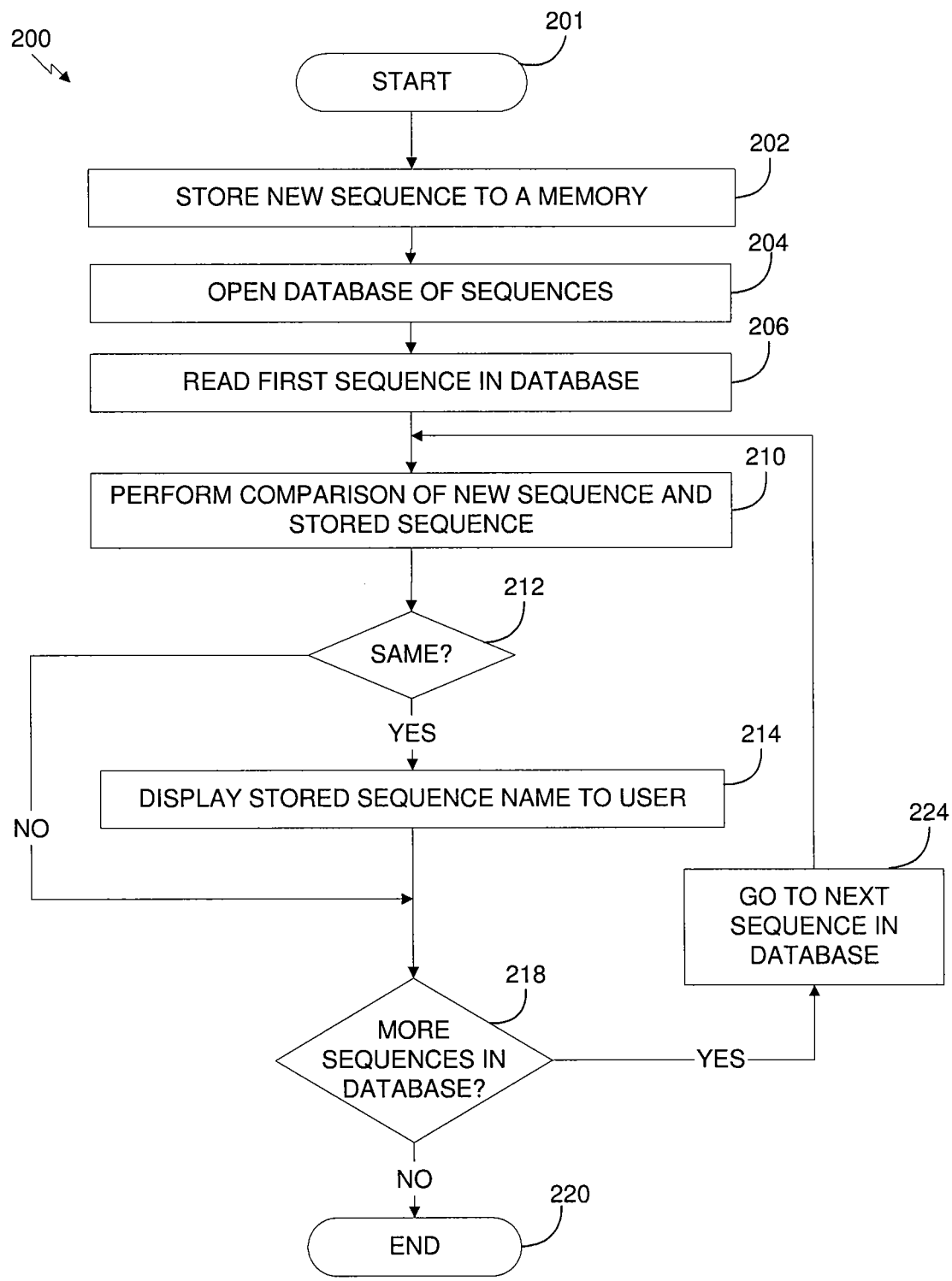
FIG. 2 is a flow diagram illustrating one aspect of a process for comparing a new nucleotide or protein sequence with a database of sequences in order to determine the homology levels between the new sequence and the sequences in the database.

FIG. 2 is a flow diagram illustrating one aspect of a process 200 for comparing a new nucleotide or protein sequence with a database of sequences in order to determine the homology levels between the new sequence and the sequences in the database. The database of sequences can be a private database stored within the computer system 100, or a public database such as GENBANK that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the invention is a computer system comprising a processor, a data storage device having stored thereon a nucleic acid sequence of the invention and sequences substantially identical thereto, or a polypeptide sequence of the invention and sequences substantially identical thereto, a data storage device having retrievably stored thereon reference nucleotide sequences or polypeptide sequences to be compared to a nucleic acid sequence of the invention and sequences substantially identical thereto, or a polypeptide sequence of the invention and sequences substantially identical thereto and a sequence comparer for conducting the comparison. The sequence comparer may indicate a homology level between the sequences compared or identify structural motifs in the above described nucleic acid code of nucleic acid sequences of the invention and sequences substantially identical thereto, or a polypeptide sequence of the invention and sequences substantially identical thereto, or it may identify structural motifs in sequences which are compared to these nucleic acid codes and polypeptide codes. In some aspects, the data storage device may have stored thereon the sequences of at least 2, 5, 10, 15, 20, 25, 30 or 40 or more of the nucleic acid sequences of the invention and sequences substantially identical thereto, or the polypeptide sequences of the invention and sequences substantially identical thereto.

Another aspect of the invention is a method for determining the level of homology between a nucleic acid sequence of the invention and sequences substantially identical thereto, or a polypeptide sequence of the invention and sequences substantially identical thereto and a reference nucleotide sequence. The method including reading the nucleic acid code or the polypeptide code and the reference nucleotide or polypeptide sequence through the use of a computer program which determines homology levels and determining homology between the nucleic acid code or polypeptide code and the reference nucleotide or polypeptide sequence with the computer program. The computer program may be any of a number of computer programs for determining homology levels, including those specifically enumerated herein, (e.g., BLAST2N with the default parameters or with any modified parameters). The method may be implemented using the computer systems described above. The method may also be performed by reading at least 2, 5, 10, 15, 20, 25, or 40 or more of the above described nucleic acid sequences of the invention, or the polypeptide sequences of the invention through use of the computer program and determining homology between the nucleic acid codes or polypeptide codes and reference nucleotide sequences or polypeptide sequences.

Figure 3:
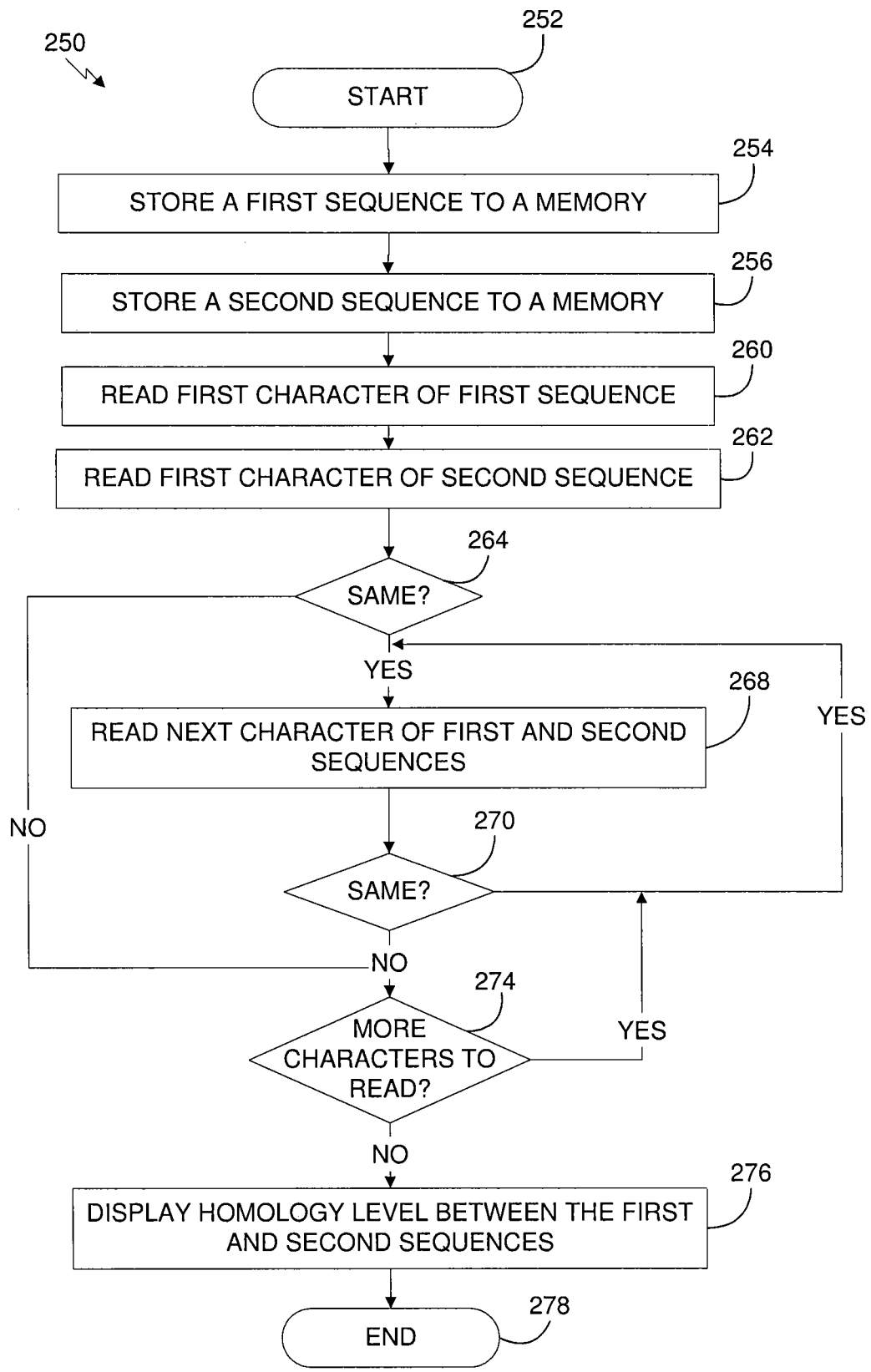
FIG. 3 is a flow diagram illustrating one aspect of a process in a computer for determining whether two sequences are homologous.

FIG. 3 is a flow diagram illustrating one aspect of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it is preferably in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there are not any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of a nucleic acid sequence as set forth in the invention, to one or more reference nucleotide sequences in order to determine whether the nucleic acid code of a nucleic acid sequence of the invention and sequences substantially identical thereto, differs from a reference nucleic acid sequence at one or more positions. In one aspect such a program records the length and identity of inserted, deleted or substituted nucleotides with respect to the sequence of either the reference polynucleotide or a nucleic acid sequence of the invention and sequences substantially identical thereto. In one aspect, the computer program may be a program which determines whether a nucleic acid sequence of the invention and sequences substantially identical thereto, contains a single nucleotide polymorphism (SNP) with respect to a reference nucleotide sequence.

Another aspect of the invention is a method for determining whether a nucleic acid sequence of the invention and sequences substantially identical thereto, differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some aspects, the computer program is a program which identifies single nucleotide polymorphisms. The method may be implemented by the computer systems described above and the method illustrated in FIG. 3. The method may also be performed by reading at least 2, 5, 10, 15, 20, 25, 30, or 40 or more of the nucleic acid sequences of the invention and sequences substantially identical thereto and the reference nucleotide sequences through the use of the computer program and identifying differences between the nucleic acid codes and the reference nucleotide sequences with the computer program.

In other aspects the computer based system may further comprise an identifier for identifying features within a nucleic acid sequence of the invention or a polypeptide sequence of the invention and sequences substantially identical thereto.

An "identifier" refers to one or more programs which identifies certain features within a nucleic acid sequence of the invention and sequences substantially identical thereto, or a polypeptide sequence of the invention and sequences substantially identical thereto. In one aspect, the identifier may comprise a program which identifies an open reading frame in a nucleic acid sequence of the invention and sequences substantially identical thereto.

Figure 4:
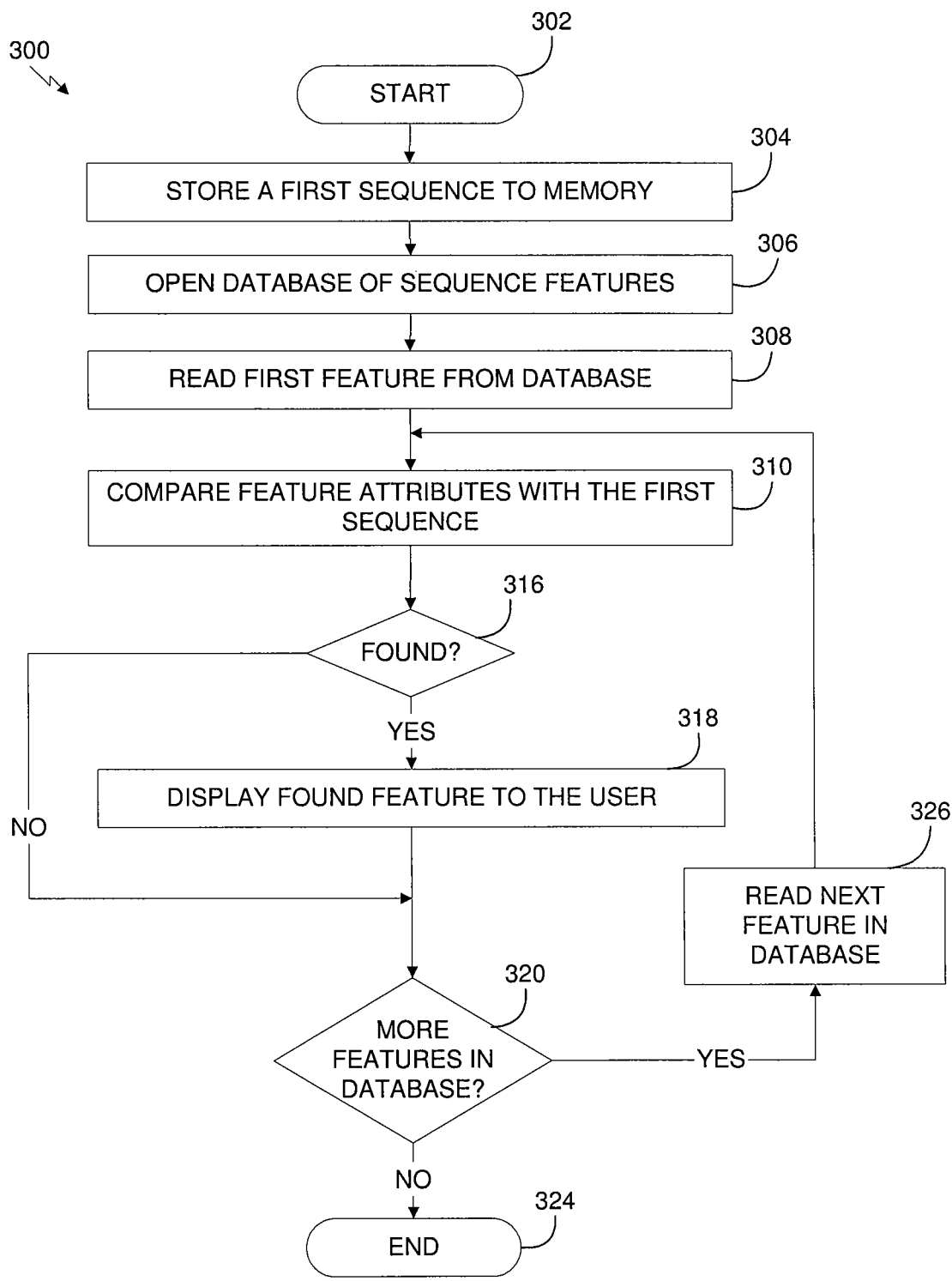
FIG. 4 is a flow diagram illustrating one aspect of an identifier process 300 for detecting the presence of a feature in a sequence.

FIG. 4 is a flow diagram illustrating one aspect of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group. Alternatively, the features may be structural polypeptide motifs such as alpha helices, beta sheets, or functional polypeptide motifs such as enzymatic active sites, helix-turn-helix motifs or other motifs known to those skilled in the art.

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence. It should be noted, that if the feature attribute is not found in the first sequence at the decision state 316, the process 300 moves directly to the decision state 320 in order to determine if any more features exist in the database.

Accordingly, another aspect of the invention is a method of identifying a feature within a nucleic acid sequence of the invention and sequences substantially identical thereto, or a polypeptide sequence of the invention and sequences substantially identical thereto, comprising reading the nucleic acid code(s) or polypeptide code(s) through the use of a computer program which identifies features therein and identifying features within the nucleic acid code(s) with the computer program. In one aspect, computer program comprises a computer program which identifies open reading frames. The method may be performed by reading a single sequence or at least 2, 5, 10, 15, 20, 25, 30, or 40 of the nucleic acid sequences of the invention and sequences substantially identical thereto, or the polypeptide sequences of the invention and sequences substantially identical thereto, through the use of the computer program and identifying features within the nucleic acid codes or polypeptide codes with the computer program.

A nucleic acid sequence of the invention and sequences substantially identical thereto, or a polypeptide sequence of the invention and sequences substantially identical thereto, may be stored and manipulated in a variety of data processor programs in a variety of formats. For example, a nucleic acid sequence of the invention and sequences substantially identical thereto, or a polypeptide sequence of the invention and sequences substantially identical thereto, may be stored as text in a word processing file, such as Microsoft WORD™ or WORDPERFECT™ or as an ASCII file in a variety of database programs familiar to those of skill in the art, such as DB2™, SYBASE™, or ORACLE™. In addition, many computer programs and databases may be used as sequence comparison algorithms, identifiers, or sources of reference nucleotide sequences or polypeptide sequences to be compared to a nucleic acid sequence of the invention and sequences substantially identical thereto, or a polypeptide sequence of the invention and sequences substantially identical thereto. The following list is intended not to limit the invention but to provide guidance to programs and databases which are useful with the nucleic acid sequences of the invention and sequences substantially identical thereto, or the polypeptide sequences of the invention and sequences substantially identical thereto.

The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, J. Mol. Biol. 215: 403, 1990), FASTA (Pearson and Lipman, Proc. Natl. Acad. Sci. USA, 85: 2444, 1988), FASTDB (Brutlag et al. Comp. App. Biosci. 6:237-245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the MDL Available Chemicals Directory database, the MDL Drug Data Report data base, the Comprehensive Medicinal Chemistry database, Derwents's World Drug Index database, the BioByteMasterFile database, the Genbank database and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices and beta sheets, signal sequences encoding signal peptides which direct the secretion of the encoded proteins, sequences implicated in transcription regulation such as homeoboxes, acidic stretches, enzymatic active sites, substrate binding sites and enzymatic cleavage sites.

Hybridization of Nucleic Acids

The invention provides isolated, synthetic or recombinant nucleic acids that hybridize under stringent conditions to an exemplary sequence of the invention. The stringent conditions can be highly stringent conditions, medium stringent conditions and/or low stringent conditions, including the high and reduced stringency conditions described herein. In one aspect, it is the stringency of the wash conditions that set forth the conditions which determine whether a nucleic acid is within the scope of the invention, as discussed below.

In alternative aspects, nucleic acids of the invention as defined by their ability to hybridize under stringent conditions can be between about five residues and the full length of nucleic acid of the invention; e.g., they can be at least 5, 10, 15, 20, 25, 30, 35, 40, 50, 55, 60, 65, 70, 75, 80, 90, 100, 150, 200, 250, 300, 350, 400, 450, 500, 550, 600, 650, 700, 750, 800, 850, 900, 950, 1000, or more, residues in length. Nucleic acids shorter than full length are also included. These nucleic acids can be useful as, e.g., hybridization probes, labeling probes, PCR oligonucleotide probes, iRNA (single or double stranded), antisense or sequences encoding antibody binding peptides (epitopes), motifs, active sites and the like.

In one aspect, nucleic acids of the invention are defined by their ability to hybridize under high stringency comprises conditions of about 50% formamide at about 37° C. to 42° C. In one aspect, nucleic acids of the invention are defined by their ability to hybridize under reduced stringency comprising conditions in about 35% to 25% formamide at about 30° C. to 35° C.

Alternatively, nucleic acids of the invention are defined by their ability to hybridize under high stringency comprising conditions at 42° C. in 50% formamide, 5×SSPE, 0.3% SDS, and a repetitive sequence blocking nucleic acid, such as cot-1 or salmon sperm DNA (e.g., 200 ug/ml sheared and denatured salmon sperm DNA). In one aspect, nucleic acids of the invention are defined by their ability to hybridize under reduced stringency conditions comprising 35% formamide at a reduced temperature of 35° C.

In nucleic acid hybridization reactions, the conditions used to achieve a particular level of stringency will vary, depending on the nature of the nucleic acids being hybridized. For example, the length, degree of complementarity, nucleotide sequence composition (e.g., GC v. AT content) and nucleic acid type (e.g., RNA v. DNA) of the hybridizing regions of the nucleic acids can be considered in selecting hybridization conditions. An additional consideration is whether one of the nucleic acids is immobilized, for example, on a filter.

Hybridization may be carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM NaH$_2$PO$_4$, pH 7.0, 5.0 mM Na$_2$EDTA, 0.5% SDS, 10×Denhardt's and 0.5 mg/ml polyriboadenylic acid. Approximately 2×10$^7$ cpm (specific activity 4–9×10$^8$ cpm/ug) of $^{32}$P end-labeled oligonucleotide probe are then added to the solution. After 12-16 hours of incubation, the membrane is washed for 30 minutes at room temperature in 1×SET (150 mM NaCl, 20 mM Tris hydrochloride, pH 7.8, 1 mM Na$_2$EDTA) containing 0.5% SDS, followed by a 30 minute wash in fresh 1×SET at T$_m$-10° C. for the oligonucleotide probe. The membrane is then exposed to auto-radiographic film for detection of hybridization signals.

All of the foregoing hybridizations would be considered to be under conditions of high stringency.

Following hybridization, a filter can be washed to remove any non-specifically bound detectable probe. The stringency used to wash the filters can also be varied depending on the nature of the nucleic acids being hybridized, the length of the nucleic acids being hybridized, the degree of complementarity, the nucleotide sequence composition (e.g., GC v. AT content) and the nucleic acid type (e.g., RNA v. DNA). Examples of progressively higher stringency condition washes are as follows: 2×SSC, 0.1% SDS at room temperature for 15 minutes (low stringency); 0.1×SSC, 0.5% SDS at room temperature for 30 minutes to 1 hour (moderate stringency); 0.1×SSC, 0.5% SDS for 15 to 30 minutes at between the hybridization temperature and 68° C. (high stringency); and 0.15M NaCl for 15 minutes at 72° C. (very high stringency). A final low stringency wash can be conducted in 0.1×SSC at room temperature. The examples above are merely illustrative of one set of conditions that can be used to wash filters. One of skill in the art would know that there are numerous recipes for different stringency washes. Some other examples are given below.

Nucleic acids which have hybridized to the probe are identified by autoradiography or other conventional techniques.

The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a Na+ concentration of approximately 1M. Following hybridization, the filter may be washed with 2×SSC, 0.5% SDS at the temperature of hybridization. These conditions are considered to be "moderate" conditions above 50° C. and "low" conditions below 50° C. A specific example of "moderate" hybridization conditions is when the above hybridization is conducted at 55° C. A specific example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

However, the selection of a hybridization format is not critical—it is the stringency of the wash conditions that set forth the conditions which determine whether a nucleic acid is within the scope of the invention. Wash conditions used to identify nucleic acids within the scope of the invention include, e.g.: a salt concentration of about 0.02 molar at pH 7 and a temperature of at least about 50° C. or about 55° C. to about 60° C.; or, a salt concentration of about 0.15 M NaCl at 72° C. for about 15 minutes; or, a salt concentration of about 0.2×SSC at a temperature of at least about 50° C. or about 55° C. to about 60° C. for about 15 to about 20 minutes; or, the hybridization complex is washed twice with a solution with a salt concentration of about 2×SSC containing 0.1% SDS at room temperature for 15 minutes and then washed twice by 0.1×SSC containing 0.1% SDS at 68° C. for 15 minutes; or, equivalent conditions. See Sambrook, Tijssen and Ausubel for a description of SSC buffer and equivalent conditions.

These methods may be used to isolate nucleic acids of the invention. For example, the preceding methods may be used to isolate nucleic acids having a sequence with at least about 97%, at least 95%, at least 90%, at least 85%, at least 80%, at least 75%, at least 70%, at least 65%, at least 60%, at least 55%, or at least 50% homology to a nucleic acid sequence selected from the group consisting of one of the sequences of The invention and sequences substantially identical thereto, or fragments comprising at least about 10, 15, 20, 25, 30, 35, 40, 50, 75, 100, 150, 200, 300, 400, or 500 consecutive bases thereof and the sequences complementary thereto. Homology may be measured using the alignment algorithm. For example, the homologous polynucleotides may have a coding sequence which is a naturally occurring allelic variant of one of the coding sequences described herein. Such allelic variants may have a substitution, deletion or addition of one or more nucleotides when compared to the nucleic acids of The invention or the sequences complementary thereto.

Additionally, the above procedures may be used to isolate nucleic acids which encode polypeptides having at least about 99%, 95%, at least 90%, at least 85%, at least 80%, at least 75%, at least 70%, at least 65%, at least 60%, at least 55%, or at least 50% homology to a polypeptide having the sequence of one of amino acid sequences of the invention, or fragments comprising at least 5, 10, 15, 20, 25, 30, 35, 40, 50, 75, 100, or 150 consecutive amino acids thereof as determined using a sequence alignment algorithm (e.g., such as the FASTA version 3.0t78 algorithm with the default parameters).

Oligonucleotides Probes and Methods for Using them

The invention also provides nucleic acid probes that can be used, e.g., for identifying nucleic acids encoding a polypeptide with an isomerase, e.g., racemase, e.g., amino acid racemase, alanine racemase, and/or epimerase activity or fragments thereof or for identifying isomerase, e.g., racemase, e.g., amino acid racemase, alanine racemase, and/or epimerase genes. In one aspect, the probe comprises at least 10 consecutive bases of a nucleic acid of the invention. Alternatively, a probe of the invention can be at least about 5, 6, 7, 8, 9, 10, 11, 12, 13, 14, 15, 16, 17, 18, 19, 20, 21, 22, 23, 24, 25, 30, 35, 40, 45, 50, 60, 70, 80, 90, 100, 110, 120, 130, 150 or about 10 to 50, about 20 to 60 about 30 to 70, consecutive bases of a sequence as set forth in a nucleic acid of the invention. The probes identify a nucleic acid by binding and/or hybridization. The probes can be used in arrays of the invention, see discussion below, including, e.g., capillary arrays. The probes of the invention can also be used to isolate other nucleic acids or polypeptides.

The isolated nucleic acids of the invention and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of The invention and sequences substantially identical thereto, or the sequences complementary thereto may also be used as probes to determine whether a biological sample, such as a soil sample, contains an organism having a nucleic acid sequence of the invention or an organism from which the nucleic acid was obtained. In such procedures, a biological sample potentially harboring the organism from which the nucleic acid was isolated is obtained and nucleic acids are obtained from the sample. The nucleic acids are contacted with the probe under conditions which permit the probe to specifically hybridize to any complementary sequences from which are present therein.

Where necessary, conditions which permit the probe to specifically hybridize to complementary sequences may be determined by placing the probe in contact with complementary sequences from samples known to contain the complementary sequence as well as control sequences which do not contain the complementary sequence. Hybridization conditions, such as the salt concentration of the hybridization buffer, the formamide concentration of the hybridization buffer, or the hybridization temperature, may be varied to identify conditions which allow the probe to hybridize specifically to complementary nucleic acids.

If the sample contains the organism from which the nucleic acid was isolated, specific hybridization of the probe is then detected. Hybridization may be detected by labeling the probe with a detectable agent such as a radioactive isotope, a fluorescent dye or an enzyme capable of catalyzing the formation of a detectable product.

Many methods for using the labeled probes to detect the presence of complementary nucleic acids in a sample are familiar to those skilled in the art. These include Southern Blots, Northern Blots, colony hybridization procedures and dot blots. Protocols for each of these procedures are provided in Ausubel et al. *Current Protocols in Molecular Biology*, John Wiley 503 Sons, Inc. (1997) and Sambrook et al., *Molecular Cloning: A Laboratory Manual 2nd Ed.*, Cold Spring Harbor Laboratory Press (1989.

Alternatively, more than one probe (at least one of which is capable of specifically hybridizing to any complementary sequences which are present in the nucleic acid sample), may be used in an amplification reaction to determine whether the sample contains an organism containing a nucleic acid sequence of the invention (e.g., an organism from which the nucleic acid was isolated). Typically, the probes comprise oligonucleotides. In one aspect, the amplification reaction may comprise a PCR reaction. PCR protocols are described in Ausubel and Sambrook, supra. Alternatively, the amplification may comprise a ligase chain reaction, 3SR, or strand displacement reaction. (See Barany, F., "The Ligase Chain Reaction in a PCR World", *PCR Methods and Applications* 1:5-16, 1991; E. Fahy et al., "Self-sustained Sequence Replication (3SR): An Isothermal Transcription-based Amplification System Alternative to PCR", *PCR Methods and Applications* 1:25-33, 1991; and Walker G. T. et al., "Strand Displacement Amplification—an Isothermal in vitro DNA Amplification Technique", *Nucleic Acid Research* 20:1691-1696, 1992). In such procedures, the nucleic acids in the sample are contacted with the probes, the amplification reaction is performed and any resulting amplification product is detected. The amplification product may be detected by performing gel electrophoresis on the reaction products and staining the gel with an intercalator such as ethidium bromide. Alternatively, one or more of the probes may be labeled with a radioactive isotope and the presence of a radioactive amplification product may be detected by autoradiography after gel electrophoresis.

Probes derived from sequences near the ends of the sequences of The invention and sequences substantially identical thereto, may also be used in chromosome walking procedures to identify clones containing genomic sequences located adjacent to the sequences of The invention and sequences substantially identical thereto. Such methods allow the isolation of genes which encode additional proteins from the host organism.

The isolated nucleic acids of the invention and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of the invention and sequences substantially identical thereto, or the sequences complementary thereto may be used as probes to identify and isolate related nucleic acids. In some aspects, the related nucleic acids may be cDNAs or genomic DNAs from organisms other than the one from which the nucleic acid was isolated. For example, the other organisms may be related organisms. In such procedures, a nucleic acid sample is contacted with the probe under conditions which permit the probe to specifically hybridize to related sequences. Hybridization of the probe to nucleic acids from the related organism is then detected using any of the methods described above.

By varying the stringency of the hybridization conditions used to identify nucleic acids, such as cDNAs or genomic DNAs, which hybridize to the detectable probe, nucleic acids having different levels of homology to the probe can be identified and isolated. Stringency may be varied by conducting the hybridization at varying temperatures below the melting temperatures of the probes. The melting temperature, $T_m$, is the temperature (under defined ionic strength and pH) at which 50% of the target sequence hybridizes to a perfectly complementary probe. Very stringent conditions are selected to be equal to or about 5° C. lower than the $T_m$ for a particular probe. The melting temperature of the probe may be calculated using the following formulas:

For probes between 14 and 70 nucleotides in length the melting temperature ($T_m$) is calculated using the formula: $T_m=81.5+16.6(\log [Na+])+0.41(\text{fraction } G+C)-(600/N)$ where N is the length of the probe.

If the hybridization is carried out in a solution containing formamide, the melting temperature may be calculated using the equation: $T_m=81.5+16.6(\log [Na+])+0.41(\text{fraction } G+C)-(0.63\% \text{ formamide})-(600/N)$ where N is the length of the probe.

Prehybridization may be carried out in 6×SSC, 5×Denhardt's reagent, 0.5% SDS, 100 µg/ml denatured fragmented salmon sperm DNA or 6×SSC, 5×Denhardt's reagent, 0.5% SDS, 100 µg/ml denatured fragmented salmon sperm DNA, 50% formamide. The formulas for SSC and Denhardt's solutions are listed in Sambrook et al., supra.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the $T_m$. For shorter probes, such as oligonucleotide probes, the hybridization may be conducted at 5-10° C. below the $T_m$. Typically, for hybridizations in 6×SSC, the hybridization is conducted at approximately 68° C. Usually, for hybridizations in 50% formamide containing solutions, the hybridization is conducted at approximately 42° C.

Inhibiting Expression of Isomerases

The invention provides nucleic acids complementary to (e.g., antisense sequences to) the nucleic acids of the invention, e.g., an isomerase-, e.g., a racemase-, e.g., an amino acid racemase-, an alanine racemase-, and/or an epimerase-isomerase-, e.g., racemase-, e.g., amino acid racemase-, alanine racemase-, and/or epimerase-encoding nucleic acids. Antisense sequences are capable of inhibiting the transport, splicing or transcription of an isomerase-, e.g., a racemase-, e.g., an amino acid racemase-, an alanine racemase-, and/or an epimerase-isomerase-, e.g., racemase-, e.g., amino acid racemase-, alanine racemase-, and/or epimerase-encoding genes. The inhibition can be effected through the targeting of genomic DNA or messenger RNA. The transcription or function of targeted nucleic acid can be inhibited, for example, by hybridization and/or cleavage. One particularly useful set of inhibitors provided by the present invention includes oligonucleotides which are able to either bind an isomerase, e.g., racemase, e.g., amino acid racemase, alanine racemase, and/or epimerase gene or message, in either case preventing or inhibiting the production or function of an isomerase, e.g., racemase, e.g., amino acid racemase, alanine racemase, and/or epimerase. The association can be through sequence specific hybridization. Another useful class of inhibitors includes oligonucleotides which cause inactivation or cleavage of an isomerase, e.g., racemase, e.g., amino acid racemase, alanine racemase, and/or epimerase message. The oligonucleotide can have enzyme activity which causes such cleavage, such as ribozymes. The oligonucleotide can be chemically modified or conjugated to an enzyme or composition capable of cleaving the complementary nucleic acid. A pool of many different such oligonucleotides can be screened for those with the desired activity. Thus, the invention provides various compositions for the inhibition of isomerase, e.g., racemase, e.g., amino acid racemase, alanine racemase, and/or epimerase expression on a nucleic acid and/or protein level, e.g., antisense, iRNA and ribozymes comprising isomerase, e.g., racemase, e.g., amino acid racemase, alanine racemase, and/or epimerase sequences of the invention and the anti-isomerase, e.g., anti-racemase, e.g., anti-amino acid racemase, anti-alanine racemase, and/or anti-epimerase antibodies of the invention.

The compositions of the invention for the inhibition of isomerase, e.g., racemase, e.g., amino acid racemase, alanine racemase, and/or epimerase expression (e.g., antisense, iRNA, ribozymes, antibodies) can be used as pharmaceutical compositions.

Antisense Oligonucleotides

The invention provides antisense oligonucleotides capable of binding an isomerase, e.g., racemase, e.g., amino acid racemase, alanine racemase, and/or epimerase message which can inhibit, for example, isomerase, e.g., racemase, e.g., amino acid racemase, alanine racemase, and/or epimerase activity by targeting mRNA. Strategies for designing antisense oligonucleotides are well described in the scientific and patent literature, and the skilled artisan can design such isomerase, e.g., racemase, e.g., amino acid racemase, alanine racemase, and/or epimerase oligonucleotides using the novel reagents of the invention. For example, gene walking/RNA mapping protocols to screen for effective antisense oligonucleotides are well known in the art, see, e.g., Ho (2000) Methods Enzymol. 314:168-183, describing an RNA mapping assay, which is based on standard molecular techniques to provide an easy and reliable method for potent antisense sequence selection. See also Smith (2000) Eur. J. Pharm. Sci. 11:191-198.

Naturally occurring nucleic acids are used as antisense oligonucleotides. The antisense oligonucleotides can be of any length; for example, in alternative aspects, the antisense oligonucleotides are between about 5 to 100, about 10 to 80, about 15 to 60, about 18 to 40. The optimal length can be determined by routine screening. The antisense oligonucleotides can be present at any concentration. The optimal concentration can be determined by routine screening. A wide variety of synthetic, non-naturally occurring nucleotide and nucleic acid analogues are known which can address this potential problem. For example, peptide nucleic acids (PNAs) containing non-ionic backbones, such as N-(2-aminoethyl) glycine units can be used. Antisense oligonucleotides having phosphorothioate linkages can also be used, as described in WO 97/03211; WO 96/39154; Mata (1997) Toxicol Appl Pharmacol 144:189-197; Antisense Therapeutics, ed. Agrawal (Humana Press, Totowa, N.J., 1996). Antisense oligonucleotides having synthetic DNA backbone analogues provided by the invention can also include phosphorodithioate, methylphosphonate, phosphoramidate, alkyl phosphotriester, sulfamate, 3'-thioacetal, methylene(methylimino), 3'-N-carbamate, and morpholino carbamate nucleic acids, as described above.

Combinatorial chemistry methodology can be used to create vast numbers of oligonucleotides that can be rapidly screened for specific oligonucleotides that have appropriate binding affinities and specificities toward any target, such as the sense and antisense isomerase, e.g., racemase, e.g., amino acid racemase, alanine racemase, and/or epimerase sequences of the invention (see, e.g., Gold (1995) J. of Biol. Chem. 270:13581-13584).

Inhibitory Ribozymes

The invention provides ribozymes capable of binding an isomerase, e.g., racemase, e.g., amino acid racemase, alanine racemase, and/or epimerase message. These ribozymes can inhibit isomerase, e.g., racemase, e.g., amino acid racemase, alanine racemase, and/or epimerase activity by, e.g., targeting mRNA. Strategies for designing ribozymes and selecting the an isomerase-, e.g., a racemase-, e.g., an amino acid racemase-, an alanine racemase-, and/or an epimerase-isomerase-, e.g., racemase-, e.g., amino acid racemase-, alanine racemase-, and/or epimerase-specific antisense sequence for targeting are well described in the scientific and patent literature, and the skilled artisan can design such ribozymes using the novel reagents (e.g. nucleic acids) of the invention. Ribozymes act by binding to a target RNA through the target RNA binding portion of a ribozyme which is held in close proximity to an enzymatic portion of the RNA that cleaves the target RNA. Thus, the ribozyme recognizes and binds a target RNA through complementary base-pairing, and once bound to the correct site, acts enzymatically to cleave and inactivate the target RNA. Cleavage of a target RNA in such a manner will destroy its ability to direct synthesis of an encoded protein if the cleavage occurs in the coding sequence. After a ribozyme has bound and cleaved its RNA target, it can be released from that RNA to bind and cleave new targets repeatedly.

In some circumstances, the enzymatic nature of a ribozyme can be advantageous over other technologies, such as antisense technology (where a nucleic acid molecule simply binds to a nucleic acid target to block its transcription, translation or association with another molecule) as the effective concentration of ribozyme necessary to effect a therapeutic treatment can be lower than that of an antisense oligonucleotide. This potential advantage reflects the ability of the ribozyme to act enzymatically. Thus, a single ribozyme molecule is able to cleave many molecules of target RNA. In addition, a ribozyme is typically a highly specific inhibitor, with the specificity of inhibition depending not only on the base pairing mechanism of binding, but also on the mechanism by which the molecule inhibits the expression of the RNA to which it binds. That is, the inhibition is caused by cleavage of the RNA target and so specificity is defined as the ratio of the rate of cleavage of the targeted RNA over the rate of cleavage of non-targeted RNA. This cleavage mechanism is dependent upon factors additional to those involved in base pairing. Thus, the specificity of action of a ribozyme can be greater than that of antisense oligonucleotide binding the same RNA site.

The ribozyme of the invention, e.g., an enzymatic ribozyme RNA molecule, can be formed in a hammerhead motif, a hairpin motif, as a hepatitis delta virus motif, a group I intron motif and/or an RNaseP-like RNA in association with an RNA guide sequence. Examples of hammerhead motifs are described by, e.g., Rossi (1992) Aids Research and Human Retroviruses 8:183; hairpin motifs by Hampel (1989) Biochemistry 28:4929, and Hampel (1990) Nuc. Acids Res. 18:299; the hepatitis delta virus motif by Perrotta (1992) Biochemistry 31:16; the RNaseP motif by Guerrier-Takada (1983) Cell 35:849; and the group I intron by Cech U.S. Pat. No. 4,987,071. The recitation of these specific motifs is not intended to be limiting. Those skilled in the art will recognize that a ribozyme of the invention, e.g., an enzymatic RNA molecule of this invention, can have a specific substrate binding site complementary to one or more of the target gene RNA regions. A ribozyme of the invention can have a nucleotide sequence within or surrounding that substrate binding site which imparts an RNA cleaving activity to the molecule.

RNA Interference (RNAi)

In one aspect, the invention provides an RNA inhibitory molecule, a so-called "RNAi" molecule, comprising an isomerase, e.g., racemase, e.g., amino acid racemase, alanine racemase, and/or epimerase enzyme sequence of the invention. The RNAi molecule can comprise a double-stranded RNA (dsRNA) molecule, e.g., siRNA, miRNA and/or short hairpin RNA (shRNA) molecules. The RNAi molecule, e.g., siRNA (small inhibitory RNA) can inhibit expression of an isomerase, e.g., racemase, e.g., amino acid racemase, alanine racemase, and/or epimerase enzyme gene, and/or miRNA (micro RNA) to inhibit translation of an isomerase, e.g., racemase, e.g., amino acid racemase, alanine racemase, and/or epimerase message. In one aspect, the RNAi molecule, e.g., siRNA and/or miRNA, is about 11, 12, 13, 14, 15, 16, 17, 18, 19, 20, 21, 22, 23, 24, 25, 26, 27, 28, 29 or more duplex nucleotides in length. While the invention is not limited by any particular mechanism of action, the RNAi can enter a cell and cause the degradation of a single-stranded RNA (ssRNA) of similar or identical sequences, including endogenous mRNAs. When a cell is exposed to double-stranded RNA (dsRNA), mRNA from the homologous gene is selectively degraded by a process called RNA interference (RNAi). A possible basic mechanism behind RNAi is the breaking of a double-stranded RNA (dsRNA) matching a specific gene sequence into short pieces called short interfering RNA, which trigger the degradation of mRNA that matches its sequence. In one aspect, the RNAi's of the invention are used in gene-silencing therapeutics, see, e.g., Shuey (2002) Drug Discov. Today 7:1040-1046. In one aspect, the invention provides methods to selectively degrade RNA using the RNAi's molecules, e.g., siRNA and/or miRNA, of the invention. The process may be practiced in vitro, ex vivo or in vivo. In one aspect, the RNAi molecules of the invention can be used to generate a loss-of-function mutation in a cell, an organ or an animal.

In one aspect, intracellular introduction of the RNAi is by internalization of a target cell specific ligand bonded to an RNA binding protein comprising an RNAi (e.g., microRNA) is adsorbed. The ligand is specific to a unique target cell surface antigen. The ligand can be spontaneously internalized after binding to the cell surface antigen. If the unique cell surface antigen is not naturally internalized after binding to its ligand, internalization can be promoted by the incorporation of an arginine-rich peptide, or other membrane permeable peptide, into the structure of the ligand or RNA binding protein or attachment of such a peptide to the ligand or RNA binding protein. See, e.g., U.S. Patent App. Pub. Nos. 20060030003; 20060025361; 20060019286; 20060019258. In one aspect, the invention provides lipid-based formulations for delivering, e.g., introducing nucleic acids of the invention as nucleic acid-lipid particles comprising an RNAi molecule to a cell, see e.g., U.S. Patent App. Pub. No. 20060008910.

Methods for making and using RNAi molecules, e.g., siRNA and/or miRNA, for selectively degrade RNA are well known in the art, see, e.g., U.S. Pat. Nos. 6,506,559; 6,511,824; 6,515,109; 6,489,127.

Modification of Nucleic Acids

The invention provides methods of generating variants of the nucleic acids of the invention, e.g., those encoding an isomerase, e.g., racemase, e.g., amino acid racemase, alanine racemase, and/or epimerase. These methods can be repeated or used in various combinations to generate isomerases, e.g., racemases, e.g., amino acid racemases, alanine racemases, and/or epimerases having an altered or different activity or an altered or different stability from that of an isomerase, e.g., racemase, e.g., amino acid racemase, alanine racemase, and/or epimerase encoded by the template nucleic acid. These methods also can be repeated or used in various combinations, e.g., to generate variations in gene/message expression, message translation or message stability. In another aspect, the genetic composition of a cell is altered by, e.g., modification of a homologous gene ex vivo, followed by its reinsertion into the cell.

A nucleic acid of the invention can be altered by any means. For example, random or stochastic methods, or, non-stochastic, or "directed evolution," methods, see, e.g., U.S. Pat. No. 6,361,974. Methods for random mutation of genes are well known in the art, see, e.g., U.S. Pat. No. 5,830,696. For example, mutagens can be used to randomly mutate a gene. Mutagens include, e.g., ultraviolet light or gamma irradiation, or a chemical mutagen, e.g., mitomycin, nitrous acid, photo-activated psoralens, alone or in combination, to induce DNA breaks amenable to repair by recombination. Other chemical mutagens include, for example, sodium bisulfite, nitrous acid, hydroxylamine, hydrazine or formic acid. Other mutagens are analogues of nucleotide precursors, e.g., nitrosoguanidine, 5-bromouracil, 2-aminopurine, or acridine. These agents can be added to a PCR reaction in place of the nucleotide precursor thereby mutating the sequence. Intercalating agents such as proflavine, acriflavine, quinacrine and the like can also be used.

Any technique in molecular biology can be used, e.g., random PCR mutagenesis, see, e.g., Rice (1992) Proc. Natl. Acad. Sci. USA 89:5467-5471; or, combinatorial multiple cassette mutagenesis, see, e.g., Crameri (1995) Biotechniques 18:194-196. Alternatively, nucleic acids, e.g., genes, can be reassembled after random, or "stochastic," fragmentation, see, e.g., U.S. Pat. Nos. 6,291,242; 6,287,862; 6,287,861; 5,955,358; 5,830,721; 5,824,514; 5,811,238; 5,605,793. In alternative aspects, modifications, additions or deletions are introduced by error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (e.g., GeneReassembly, see, e.g., U.S. Pat. No. 6,537,776), gene site saturation mutagenesis (GSSM), synthetic ligation reassembly (SLR), recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation, and/or a combination of these and other methods.

The following publications describe a variety of recursive recombination procedures and/or methods which can be incorporated into the methods of the invention: Stemmer (1999) "Molecular breeding of viruses for targeting and other clinical properties" Tumor Targeting 4:1-4; Ness (1999) Nature Biotechnology 17:893-896; Chang (1999) "Evolution of a cytokine using DNA family shuffling" Nature Biotechnology 17:793-797; Minshull (1999) "Protein evolution by molecular breeding" Current Opinion in Chemical Biology 3:284-290; Christians (1999) "Directed evolution of thymidine kinase for AZT phosphorylation using DNA family shuffling" Nature Biotechnology 17:259-264; Crameri (1998) "DNA shuffling of a family of genes from diverse species accelerates directed evolution" Nature 391:288-291; Crameri (1997) "Molecular evolution of an arsenate detoxification pathway by DNA shuffling," Nature Biotechnology 15:436-438; Zhang (1997) "Directed evolution of an effective fucosidase from a galactosidase by DNA shuffling and screening" Proc. Natl. Acad. Sci. USA 94:4504-4509; Patten et al. (1997) "Applications of DNA Shuffling to Pharmaceuticals and Vaccines" Current Opinion in Biotechnology 8:724-733; Crameri et al. (1996) "Construction and evolution of antibody-phage libraries by DNA shuffling" Nature Medicine 2:100-103; Gates et al. (1996) "Affinity selective isolation of ligands from peptide libraries through display on a lac repressor 'headpiece dimer'" Journal of Molecular Biology 255: 373-386; Stemmer (1996) "Sexual PCR and Assembly PCR" In: The Encyclopedia of Molecular Biology. VCH Publishers, New York. pp. 447-457; Crameri and Stemmer (1995) "Combinatorial multiple cassette mutagenesis creates all the permutations of mutant and wildtype cassettes" BioTechniques 18:194-195; Stemmer et al. (1995) "Single-step assembly of a gene and entire plasmid form large numbers of oligodeoxyribonucleotides" Gene, 164:49-53; Stemmer (1995) "The Evolution of Molecular Computation" Science 270: 1510; Stemmer (1995) "Searching Sequence Space" Bio/Technology 13:549-553; Stemmer (1994) "Rapid evolution of a protein in vitro by DNA shuffling" Nature 370:389-391; and Stemmer (1994) "DNA shuffling by random fragmentation and reassembly: In vitro recombination for molecular evolution." Proc. Natl. Acad. Sci. USA 91:10747-10751.

Mutational methods of generating diversity include, for example, site-directed mutagenesis (Ling et al. (1997) "Approaches to DNA mutagenesis: an overview" Anal Biochem. 254(2): 157-178; Dale et al. (1996) "Oligonucleotide-directed random mutagenesis using the phosphorothioate method" Methods Mol. Biol. 57:369-374; Smith (1985) "In vitro mutagenesis" Ann. Rev. Genet. 19:423-462; Botstein & Shortle (1985) "Strategies and applications of in vitro mutagenesis" Science 229:1193-1201; Carter (1986) "Site-directed mutagenesis" Biochem. J. 237:1-7; and Kunkel (1987) "The efficiency of oligonucleotide directed mutagenesis" in Nucleic Acids & Molecular Biology (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" Proc. Natl. Acad. Sci. USA 82:488-492; Kunkel et al. (1987) "Rapid and efficient site-specific mutagenesis without phenotypic selection" Methods in Enzymol. 154, 367-382; and Bass et al. (1988) "Mutant Trp repressors with new DNA-binding specificities" Science 242:240-245); oligonucleotide-directed mutagenesis (Methods in Enzymol. 100: 468-500 (1983); Methods in Enzymol. 154: 329-350 (1987); Zoller (1982) "Oligonucleotide-directed mutagenesis using M13-derived vectors: an efficient and general procedure for the production of point mutations in any DNA fragment" Nucleic Acids Res. 10:6487-6500; Zoller & Smith (1983) "Oligonucleotide-directed mutagenesis of DNA fragments cloned into M13 vectors" Methods in Enzymol. 100:468-500; and Zoller (1987) Oligonucleotide-directed mutagenesis: a simple method using two oligonucleotide primers and a single-stranded DNA template" Methods in Enzymol. 154: 329-350); phosphorothioate-modified DNA mutagenesis (Taylor (1985) "The use of phosphorothioate-modified DNA in restriction enzyme reactions to prepare nicked DNA" Nucl. Acids Res. 13: 8749-8764; Taylor (1985) "The rapid generation of oligonucleotide-directed mutations at high frequency using phosphorothioate-modified DNA" Nucl. Acids Res. 13: 8765-8787 (1985); Nakamaye (1986) "Inhibition of restriction endonuclease Nci I cleavage by phosphorothioate groups and its application to oligonucleotide-directed mutagenesis" Nucl. Acids Res. 14: 9679-9698; Sayers (1988) "Y-T Exonucleases in phosphorothioate-based oligonucleotide-directed mutagenesis" Nucl. Acids Res. 16:791-802; and Sayers et al. (1988) "Strand specific cleavage of phosphorothioate-containing DNA by reaction with restriction endonucleases in the presence of ethidium bromide" Nucl. Acids Res. 16: 803-814); mutagenesis using gapped duplex DNA (Kramer et al. (1984) "The gapped duplex DNA approach to oligonucleotide-directed mutation construction" Nucl. Acids Res. 12: 9441-9456; Kramer & Fritz (1987) Methods in Enzymol. "Oligonucleotide-directed construction of mutations via gapped duplex DNA" 154:350-367; Kramer (1988) "Improved enzymatic in vitro reactions in the gapped duplex DNA approach to oligonucleotide-directed construction of mutations" Nucl. Acids Res. 16: 7207; and Fritz (1988) "Oligonucleotide-directed construction of mutations: a gapped duplex DNA procedure without enzymatic reactions in vitro" Nucl. Acids Res. 16: 6987-6999).

Additional protocols that can be used to practice the invention include point mismatch repair (Kramer (1984) "Point Mismatch Repair" Cell 38:879-887), mutagenesis using repair-deficient host strains (Carter et al. (1985) "Improved oligonucleotide site-directed mutagenesis using M13 vectors" Nucl. Acids Res. 13: 4431-4443; and Carter (1987) "Improved oligonucleotide-directed mutagenesis using M13 vectors" Methods in Enzymol. 154: 382-403), deletion mutagenesis (Eghtedarzadeh (1986) "Use of oligonucleotides to generate large deletions" Nucl. Acids Res. 14: 5115), restriction-selection and restriction-selection and restriction-purification (Wells et al. (1986) "Importance of hydrogen-bond formation in stabilizing the transition state of subtilisin" Phil. Trans. R. Soc. Lond. A 317: 415-423), mutagenesis by total gene synthesis (Nambiar et al. (1984) "Total synthesis and cloning of a gene coding for the ribonuclease S protein" Science 223: 1299-1301; Sakamar and Khorana (1988) "Total synthesis and expression of a gene for the a-subunit of bovine rod outer segment guanine nucleotide-binding protein (transducin)" Nucl. Acids Res. 14:

6361-6372; Wells et al. (1985) "Cassette mutagenesis: an efficient method for generation of multiple mutations at defined sites" Gene 34:315-323; and Grundstrom et al. (1985) "Oligonucleotide-directed mutagenesis by microscale 'shotgun' gene synthesis" Nucl. Acids Res. 13: 3305-3316), double-strand break repair (Mandecki (1986); Arnold (1993) "Protein engineering for unusual environments" Current Opinion in Biotechnology 4:450-455. "Oligonucleotide-directed double-strand break repair in plasmids of *Escherichia coli*: a method for site-specific mutagenesis" Proc. Natl. Acad. Sci. USA, 83:7177-7181). Additional details on many of the above methods can be found in Methods in Enzymology Volume 154, which also describes useful controls for trouble-shooting problems with various mutagenesis methods.

Protocols that can be used to practice the invention are described, e.g., in U.S. Pat. No. 5,605,793 to Stemmer (Feb. 25, 1997), "Methods for In Vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No. 5,837, 458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/27230 by Stemmer et al., "Methods for Optimization of Gene Therapy by Recursive Sequence Shuffling and Selection," WO 00/00632, "Methods for Generating Highly Diverse Libraries," WO 00/09679, "Methods for Obtaining in Vitro Recombined Polynucleotide Sequence Banks and Resulting Sequences," WO 98/42832 by Arnold et al., "Recombination of Polynucleotide Sequences Using Random or Defined Primers," WO 99/29902 by Arnold et al., "Method for Creating Polynucleotide and Polypeptide Sequences," WO 98/41653 by Vind, "An in Vitro Method for Construction of a DNA Library," WO 98/41622 by Borchert et al., "Method for Constructing a Library Using DNA Shuffling," and WO 98/42727 by Pati and Zarling, "Sequence Alterations using Homologous Recombination."

Protocols that can be used to practice the invention (providing details regarding various diversity generating methods) are described, e.g., in U.S. patent application Ser. No. 09/407,800, "SHUFFLING OF CODON ALTERED GENES" by Patten et al. filed Sep. 28, 1999; "EVOLUTION OF WHOLE CELLS AND ORGANISMS BY RECURSIVE SEQUENCE RECOMBINATION" by del Cardayre et al., U.S. Pat. No. 6,379,964; "OLIGONUCLEOTIDE MEDIATED NUCLEIC ACID RECOMBINATION" by Crameri et al., U.S. Pat. Nos. 6,319,714; 6,368,861; 6,376,246; 6,423, 542; 6,426,224 and PCT/US00/01203; "USE OF CODON-VARIED OLIGONUCLEOTIDE SYNTHESIS FOR SYNTHETIC SHUFFLING" by Welch et al., U.S. Pat. No. 6,436, 675; "METHODS FOR MAKING CHARACTER STRINGS, POLYNUCLEOTIDES & POLYPEPTIDES HAVING DESIRED CHARACTERISTICS" by Selifonov et al., filed Jan. 18, 2000, (PCT/US00/01202) and, e.g. "METHODS FOR MAKING CHARACTER STRINGS, POLYNUCLEOTIDES & POLYPEPTIDES HAVING DESIRED CHARACTERISTICS" by Selifonov et al., filed Jul. 18, 2000 (U.S. Ser. No. 09/618,579); "METHODS OF POPULATING DATA STRUCTURES FOR USE IN EVOLUTIONARY SIMULATIONS" by Selifonov and Stemmer, filed Jan. 18, 2000 (PCT/US00/01138); and "SINGLE-STRANDED NUCLEIC ACID TEMPLATE-MEDIATED RECOMBINATION AND NUCLEIC ACID FRAGMENT ISOLATION" by Affholter, filed Sep. 6, 2000 (U.S. Ser. No. 09/656,549); and U.S. Pat. Nos. 6,177,263; 6,153,410.

Non-stochastic, or "directed evolution," methods include, e.g., saturation mutagenesis (GSSM), synthetic ligation reassembly (SLR), or a combination thereof are used to modify the nucleic acids of the invention to generate isomerases, e.g., racemases, e.g., amino acid racemases, alanine racemases, and/or epimerases with new or altered properties (e.g., activity under highly acidic or alkaline conditions, high or low temperatures, and the like). Polypeptides encoded by the modified nucleic acids can be screened for an activity. Any testing modality or protocol can be used, e.g., using a capillary array platform. See, e.g., U.S. Pat. Nos. 6,361,974; 6,280, 926; 5,939,250.

Gene Site Saturation Mutagenesis, or, GSSM

The invention also provides methods for making enzyme using Gene Site Saturation mutagenesis, or, GSSM, as described herein, and also in U.S. Pat. Nos. 6,171,820 and 6,579,258. In one aspect, codon primers containing a degenerate N,N,G/T sequence are used to introduce point mutations into a polynucleotide, e.g., an isomerase, e.g., racemase, e.g., amino acid racemase, alanine racemase, and/or epimerase or an antibody of the invention, so as to generate a set of progeny polypeptides in which a full range of single amino acid substitutions is represented at each amino acid position, e.g., an amino acid residue in an enzyme active site or ligand binding site targeted to be modified. These oligonucleotides can comprise a contiguous first homologous sequence, a degenerate N,N,G/T sequence, and, in one aspect, a second homologous sequence. The downstream progeny translational products from the use of such oligonucleotides include all possible amino acid changes at each amino acid site along the polypeptide, because the degeneracy of the N,N,G/T sequence includes codons for all 20 amino acids. In one aspect, one such degenerate oligonucleotide (comprised of, e.g., one degenerate N,N,G/T cassette) is used for subjecting each original codon in a parental polynucleotide template to a full range of codon substitutions. In another aspect, at least two degenerate cassettes are used—either in the same oligonucleotide or not, for subjecting at least two original codons in a parental polynucleotide template to a full range of codon substitutions. For example, more than one N,N,G/T sequence can be contained in one oligonucleotide to introduce amino acid mutations at more than one site. This plurality of N,N, G/T sequences can be directly contiguous, or separated by one or more additional nucleotide sequence(s). In another aspect, oligonucleotides serviceable for introducing additions and deletions can be used either alone or in combination with the codons containing an N,N,G/T sequence, to introduce any combination or permutation of amino acid additions, deletions, and/or substitutions.

In one aspect, simultaneous mutagenesis of two or more contiguous amino acid positions is done using an oligonucleotide that contains contiguous N,N,G/T triplets, i.e. a degenerate (N,N,G/T)n sequence. In another aspect, degenerate cassettes having less degeneracy than the N,N,G/T sequence are used. For example, it may be desirable in some instances to use (e.g. in an oligonucleotide) a degenerate triplet sequence comprised of only one N, where said N can be in the first second or third position of the triplet. Any other bases including any combinations and permutations thereof can be used in the remaining two positions of the triplet. Alternatively, it may be desirable in some instances to use (e.g. in an oligo) a degenerate N,N,N triplet sequence.

In one aspect, use of degenerate triplets (e.g., N,N,G/T triplets) allows for systematic and easy generation of a full range of possible natural amino acids (for a total of 20 amino acids) into each and every amino acid position in a polypeptide (in alternative aspects, the methods also include generation of less than all possible substitutions per amino acid residue, or codon, position). For example, for a 100 amino acid polypeptide, 2000 distinct species (i.e. 20 possible amino acids per position×100 amino acid positions) can be generated. Through the use of an oligonucleotide or set of oligonucleotides containing a degenerate N,N,G/T triplet, 32 individual sequences can code for all 20 possible natural amino acids. Thus, in a reaction vessel in which a parental polynucleotide sequence is subjected to saturation mutagenesis using at least one such oligonucleotide, there are generated 32 distinct progeny polynucleotides encoding 20 distinct polypeptides. In contrast, the use of a non-degenerate oligonucleotide in site-directed mutagenesis leads to only one progeny polypeptide product per reaction vessel. Nondegenerate oligonucleotides can in one aspect be used in combination with degenerate primers disclosed; for example, nondegenerate oligonucleotides can be used to generate specific point mutations in a working polynucleotide. This provides one means to generate specific silent point mutations, point mutations leading to corresponding amino acid changes, and point mutations that cause the generation of stop codons and the corresponding expression of polypeptide fragments.

In one aspect, each saturation mutagenesis reaction vessel contains polynucleotides encoding at least 20 progeny polypeptide (e.g., isomerases, e.g., racemases, e.g., amino acid racemases, alanine racemases, and/or epimerases) molecules such that all 20 natural amino acids are represented at the one specific amino acid position corresponding to the codon position mutagenized in the parental polynucleotide (other aspects use less than all 20 natural combinations). The 32-fold degenerate progeny polypeptides generated from each saturation mutagenesis reaction vessel can be subjected to clonal amplification (e.g. cloned into a suitable host, e.g., E. coli host, using, e.g., an expression vector) and subjected to expression screening. When an individual progeny polypeptide is identified by screening to display a favorable change in property (when compared to the parental polypeptide, such as increased isomerase activity, e.g., racemase activity, e.g., amino acid racemase activity, alanine racemase activity, and/ or epimerase activity under alkaline or acidic conditions), it can be sequenced to identify the correspondingly favorable amino acid substitution contained therein.

In one aspect, upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid, and each of two favorable changes) and 3 positions. Thus, there are 3×3×3 or 27 total possibilities, including 7 that were previously examined—6 single point mutations (i.e. 2 at each of three positions) and no change at any position.

In yet another aspect, site-saturation mutagenesis can be used together with shuffling, chimerization, recombination and other mutagenizing processes, along with screening. This invention provides for the use of any mutagenizing process(es), including saturation mutagenesis, in an iterative manner. In one exemplification, the iterative use of any mutagenizing process(es) is used in combination with screening.

The invention also provides for the use of proprietary codon primers (containing a degenerate N,N,N sequence) to introduce point mutations into a polynucleotide, so as to generate a set of progeny polypeptides in which a full range of single amino acid substitutions is represented at each amino acid position (gene site saturation mutagenesis (GSSM)). The oligos used are comprised contiguously of a first homologous sequence, a degenerate N,N,N sequence and preferably but not necessarily a second homologous sequence. The downstream progeny translational products from the use of such oligos include all possible amino acid changes at each amino acid site along the polypeptide, because the degeneracy of the N,N,N sequence includes codons for all 20 amino acids.

In one aspect, one such degenerate oligo (comprised of one degenerate N,N,N cassette) is used for subjecting each original codon in a parental polynucleotide template to a full range of codon substitutions. In another aspect, at least two degenerate N,N,N cassettes are used—either in the same oligo or not, for subjecting at least two original codons in a parental polynucleotide template to a full range of codon substitutions. Thus, more than one N,N,N sequence can be contained in one oligo to introduce amino acid mutations at more than one site. This plurality of N,N,N sequences can be directly contiguous, or separated by one or more additional nucleotide sequence(s). In another aspect, oligos serviceable for introducing additions and deletions can be used either alone or in combination with the codons containing an N,N,N sequence, to introduce any combination or permutation of amino acid additions, deletions and/or substitutions.

In a particular exemplification, it is possible to simultaneously mutagenize two or more contiguous amino acid positions using an oligo that contains contiguous N,N,N triplets, i.e. a degenerate $(N,N,N)_n$ sequence.

In another aspect, the present invention provides for the use of degenerate cassettes having less degeneracy than the N,N,N sequence. For example, it may be desirable in some instances to use (e.g. in an oligo) a degenerate triplet sequence comprised of only one N, where the N can be in the first second or third position of the triplet. Any other bases including any combinations and permutations thereof can be used in the remaining two positions of the triplet. Alternatively, it may be desirable in some instances to use (e.g., in an oligo) a degenerate N,N,N triplet sequence, N,N,G/T, or an N,N, G/C triplet sequence.

It is appreciated, however, that the use of a degenerate triplet (such as N,N,G/T or an N,N, G/C triplet sequence) as disclosed in the instant invention is advantageous for several reasons. In one aspect, this invention provides a means to systematically and fairly easily generate the substitution of the full range of possible amino acids (for a total of 20 amino acids) into each and every amino acid position in a polypeptide. Thus, for a 100 amino acid polypeptide, the invention provides a way to systematically and fairly easily generate 2000 distinct species (i.e., 20 possible amino acids per position times 100 amino acid positions). It is appreciated that there is provided, through the use of an oligo containing a degenerate N,N,G/T or an N,N, G/C triplet sequence, 32 individual sequences that code for 20 possible amino acids. Thus, in a reaction vessel in which a parental polynucleotide sequence is subjected to saturation mutagenesis using one such oligo, there are generated 32 distinct progeny polynucleotides encoding 20 distinct polypeptides. In contrast, the use of a non-degenerate oligo in site-directed mutagenesis leads to only one progeny polypeptide product per reaction vessel.

This invention also provides for the use of nondegenerate oligos, which can in one aspect be used in combination with degenerate primers disclosed. It is appreciated that in some situations, it is advantageous to use nondegenerate oligos to generate specific point mutations in a working polynucleotide. This provides a means to generate specific silent point mutations, point mutations leading to corresponding amino acid changes and point mutations that cause the generation of stop codons and the corresponding expression of polypeptide fragments.

Thus, in one aspect of this invention, each saturation mutagenesis reaction vessel contains polynucleotides encoding at least 20 progeny polypeptide molecules such that all 20 amino acids are represented at the one specific amino acid position corresponding to the codon position mutagenized in the parental polynucleotide. The 32-fold degenerate progeny polypeptides generated from each saturation mutagenesis reaction vessel can be subjected to clonal amplification (e.g., cloned into a suitable $E.$ $coli$ host using an expression vector) and subjected to expression screening. When an individual progeny polypeptide is identified by screening to display a favorable change in property (when compared to the parental polypeptide), it can be sequenced to identify the correspondingly favorable amino acid substitution contained therein.

It is appreciated that upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid and each of two favorable changes) and 3 positions. Thus, there are 3×3×3 or 27 total possibilities, including 7 that were previously examined—6 single point mutations (i.e., 2 at each of three positions) and no change at any position.

Thus, in a non-limiting exemplification, this invention provides for the use of saturation mutagenesis in combination with additional mutagenization processes, such as process where two or more related polynucleotides are introduced into a suitable host cell such that a hybrid polynucleotide is generated by recombination and reductive reassortment.

In addition to performing mutagenesis along the entire sequence of a gene, the instant invention provides that mutagenesis can be use to replace each of any number of bases in a polynucleotide sequence, wherein the number of bases to be mutagenized is preferably every integer from 15 to 100,000. Thus, instead of mutagenizing every position along a molecule, one can subject every or a discrete number of bases (preferably a subset totaling from 15 to 100,000) to mutagenesis. Preferably, a separate nucleotide is used for mutagenizing each position or group of positions along a polynucleotide sequence. A group of 3 positions to be mutagenized may be a codon. The mutations are preferably introduced using a mutagenic primer, containing a heterologous cassette, also referred to as a mutagenic cassette. Exemplary cassettes can have from 1 to 500 bases. Each nucleotide position in such heterologous cassettes be N, A, C, G, T, A/C, A/G, A/T, C/G, C/T, G/T, C/G/T, A/G/T, A/C/T, A/C/G, or E, where E is any base that is not A, C, G, or T (E can be referred to as a designer oligo).

In a general sense, saturation mutagenesis is comprised of mutagenizing a complete set of mutagenic cassettes (wherein each cassette is preferably about 1-500 bases in length) in defined polynucleotide sequence to be mutagenized (wherein the sequence to be mutagenized is preferably from about 15 to 100,000 bases in length). Thus, a group of mutations (ranging from 1 to 100 mutations) is introduced into each cassette to be mutagenized. A grouping of mutations to be introduced into one cassette can be different or the same from a second grouping of mutations to be introduced into a second cassette during the application of one round of saturation mutagenesis. Such groupings are exemplified by deletions, additions, groupings of particular codons and groupings of particular nucleotide cassettes.

Defined sequences to be mutagenized include a whole gene, pathway, cDNA, an entire open reading frame (ORF) and entire promoter, enhancer, repressor/transactivator, origin of replication, intron, operator, or any polynucleotide functional group. Generally, a "defined sequences" for this purpose may be any polynucleotide that a 15 base-polynucleotide sequence and polynucleotide sequences of lengths between 15 bases and 15,000 bases (this invention specifically names every integer in between). Considerations in choosing groupings of codons include types of amino acids encoded by a degenerate mutagenic cassette.

In one exemplification a grouping of mutations that can be introduced into a mutagenic cassette, this invention specifically provides for degenerate codon substitutions (using degenerate oligos) that code for 2, 3, 4, 5, 6, 7, 8, 9, 10, 11, 12, 13, 14, 15, 16, 17, 18, 19 and 20 amino acids at each position and a library of polypeptides encoded thereby.

Synthetic Ligation Reassembly (SLR)

The invention provides a non-stochastic gene modification system termed "synthetic ligation reassembly," or simply "SLR," a "directed evolution process," to generate polypeptides, e.g., isomerases, e.g., racemases, e.g., amino acid racemases, alanine racemases, and/or epimerases, or antibodies of the invention, with new or altered properties.

SLR is a method of ligating oligonucleotide fragments together non-stochastically. This method differs from stochastic oligonucleotide shuffling in that the nucleic acid building blocks are not shuffled, concatenated or chimerized randomly, but rather are assembled non-stochastically. See, e.g., U.S. Pat. Nos. 6,773,900; 6,740,506; 6,713,282; 6,635,449; 6,605,449; 6,537,776. In one aspect, SLR comprises: (a) providing a template polynucleotide, wherein the template polynucleotide comprises sequence encoding a homologous gene; (b) providing a plurality of building block polynucleotides, wherein the building block polynucleotides are designed to cross-over reassemble with the template polynucleotide at a predetermined sequence, and a building block polynucleotide comprises a sequence that is a variant of the homologous gene and a sequence homologous to the template polynucleotide flanking the variant sequence; (c) combining a building block polynucleotide with a template polynucleotide such that the building block polynucleotide cross-over reassembles with the template polynucleotide to generate polynucleotides comprising homologous gene sequence variations.

SLR does not depend on the presence of high levels of homology between polynucleotides to be rearranged. Thus, this method can be used to non-stochastically generate libraries (or sets) of progeny molecules comprised of over $10^{100}$ different chimeras. SLR can be used to generate libraries comprised of over $10^{1000}$ different progeny chimeras. Thus, aspects of the present invention include non-stochastic methods of producing a set of finalized chimeric nucleic acid molecule shaving an overall assembly order that is chosen by design. This method includes the steps of generating by design a plurality of specific nucleic acid building blocks having serviceable mutually compatible ligatable ends, and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, the overall assembly order in which the nucleic acid building blocks can be coupled is specified by the design of the ligatable ends. If more than one assembly step is to be used, then the overall assembly order in which the nucleic acid building blocks can be coupled is also specified by the sequential order of the assembly step(s). In one aspect, the annealed building pieces are treated with an enzyme, such as a ligase (e.g. T4 DNA ligase), to achieve covalent bonding of the building pieces.

In one aspect, the design of the oligonucleotide building blocks is obtained by analyzing a set of progenitor nucleic acid sequence templates that serve as a basis for producing a progeny set of finalized chimeric polynucleotides. These parental oligonucleotide templates thus serve as a source of sequence information that aids in the design of the nucleic acid building blocks that are to be mutagenized, e.g., chimerized or shuffled. In one aspect of this method, the sequences of a plurality of parental nucleic acid templates are aligned in order to select one or more demarcation points. The demarcation points can be located at an area of homology, and are comprised of one or more nucleotides. These demarcation points are preferably shared by at least two of the progenitor templates. The demarcation points can thereby be used to delineate the boundaries of oligonucleotide building blocks to be generated in order to rearrange the parental polynucleotides. The demarcation points identified and selected in the progenitor molecules serve as potential chimerization points in the assembly of the final chimeric progeny molecules. A demarcation point can be an area of homology (comprised of at least one homologous nucleotide base) shared by at least two parental polynucleotide sequences. Alternatively, a demarcation point can be an area of homology that is shared by at least half of the parental polynucleotide sequences, or, it can be an area of homology that is shared by at least two thirds of the parental polynucleotide sequences. Even more preferably a serviceable demarcation points is an area of homology that is shared by at least three fourths of the parental polynucleotide sequences, or, it can be shared by at almost all of the parental polynucleotide sequences. In one aspect, a demarcation point is an area of homology that is shared by all of the parental polynucleotide sequences.

In one aspect, a ligation reassembly process is performed exhaustively in order to generate an exhaustive library of progeny chimeric polynucleotides. In other words, all possible ordered combinations of the nucleic acid building blocks are represented in the set of finalized chimeric nucleic acid molecules. At the same time, in another aspect, the assembly order (i.e. the order of assembly of each building block in the 5' to 3 sequence of each finalized chimeric nucleic acid) in each combination is by design (or non-stochastic) as described above. Because of the non-stochastic nature of this invention, the possibility of unwanted side products is greatly reduced.

In another aspect, the ligation reassembly method is performed systematically. For example, the method is performed in order to generate a systematically compartmentalized library of progeny molecules, with compartments that can be screened systematically, e.g. one by one. In other words this invention provides that, through the selective and judicious use of specific nucleic acid building blocks, coupled with the selective and judicious use of sequentially stepped assembly reactions, a design can be achieved where specific sets of progeny products are made in each of several reaction vessels. This allows a systematic examination and screening procedure to be performed. Thus, these methods allow a potentially very large number of progeny molecules to be examined systematically in smaller groups. Because of its ability to perform chimerizations in a manner that is highly flexible yet exhaustive and systematic as well, particularly when there is a low level of homology among the progenitor molecules, these methods provide for the generation of a library (or set) comprised of a large number of progeny molecules. Because of the non-stochastic nature of the instant ligation reassembly invention, the progeny molecules generated preferably comprise a library of finalized chimeric nucleic acid molecules having an overall assembly order that is chosen by design. The saturation mutagenesis and optimized directed evolution methods also can be used to generate different progeny molecular species. It is appreciated that the invention provides freedom of choice and control regarding the selection of demarcation points, the size and number of the nucleic acid building blocks, and the size and design of the couplings. It is appreciated, furthermore, that the requirement for intermolecular homology is highly relaxed for the operability of this invention. In fact, demarcation points can even be chosen in areas of little or no intermolecular homology. For example, because of codon wobble, i.e. the degeneracy of codons, nucleotide substitutions can be introduced into nucleic acid building blocks without altering the amino acid originally encoded in the corresponding progenitor template. Alternatively, a codon can be altered such that the coding for an originally amino acid is altered. This invention provides that such substitutions can be introduced into the nucleic acid building block in order to increase the incidence of intermolecular homologous demarcation points and thus to allow an increased number of couplings to be achieved among the building blocks, which in turn allows a greater number of progeny chimeric molecules to be generated.

Synthetic Gene Reassembly

In one aspect, the present invention provides a non-stochastic method termed synthetic gene reassembly (e.g., GeneReassembly, see, e.g., U.S. Pat. No. 6,537,776), which differs from stochastic shuffling in that the nucleic acid building blocks are not shuffled or concatenated or chimerized randomly, but rather are assembled non-stochastically.

The synthetic gene reassembly method does not depend on the presence of a high level of homology between polynucleotides to be shuffled. The invention can be used to non-stochastically generate libraries (or sets) of progeny molecules comprised of over $10^{100}$ different chimeras. Conceivably, synthetic gene reassembly can even be used to generate libraries comprised of over $10^{1000}$ different progeny chimeras.

Thus, in one aspect, the invention provides a non-stochastic method of producing a set of finalized chimeric nucleic acid molecules having an overall assembly order that is chosen by design, which method is comprised of the steps of generating by design a plurality of specific nucleic acid building blocks having serviceable mutually compatible ligatable ends and assembling these nucleic acid building blocks, such that a designed overall assembly order is achieved.

In one aspect, synthetic gene reassembly comprises a method of: 1) preparing a progeny generation of molecule(s) (including a molecule comprising a polynucleotide sequence, e.g., a molecule comprising a polypeptide coding sequence), that is mutagenized to achieve at least one point mutation, addition, deletion, &/or chimerization, from one or more ancestral or parental generation template(s); 2) screening the progeny generation molecule(s), e.g., using a high throughput method, for at least one property of interest (such as an improvement in an enzyme activity); 3) in one aspect obtaining &/or cataloguing structural &/or and functional information regarding the parental &/or progeny generation molecules; and 4) in one aspect repeating any of steps 1) to 3). In one aspect, there is generated (e.g., from a parent polynucleotide template), in what is termed "codon site-saturation mutagenesis," a progeny generation of polynucleotides, each having at least one set of up to three contiguous point mutations (i.e. different bases comprising a new codon), such that every codon (or every family of degenerate codons encoding the same amino acid) is represented at each codon position. Corresponding to, and encoded by, this progeny generation of polynucleotides, there is also generated a set of progeny polypeptides, each having at least one single amino acid point mutation. In a one aspect, there is generated, in what is termed "amino acid site-saturation mutagenesis", one such mutant polypeptide for each of the 19 naturally encoded polypeptide-forming alpha-amino acid substitutions at each and every amino acid position along the polypeptide. This yields, for each and every amino acid position along the parental polypeptide, a total of 20 distinct progeny polypeptides including the original amino acid, or potentially more than 21 distinct progeny polypeptides if additional amino acids are used either instead of or in addition to the 20 naturally encoded amino acids Thus, in another aspect, this approach is also serviceable for generating mutants containing, in addition to &/or in combination with the 20 naturally encoded polypeptide-forming alpha-amino acids, other rare &/or not naturally-encoded amino acids and amino acid derivatives. In yet another aspect, this approach is also serviceable for generating mutants by the use of, in addition to &/or in combination with natural or unaltered codon recognition systems of suitable hosts, altered, mutagenized, &/or designer codon recognition systems (such as in a host cell with one or more altered tRNA molecules.

In yet another aspect, this invention relates to recombination and more specifically to a method for preparing polynucleotides encoding a polypeptide by a method of in vivo re-assortment of polynucleotide sequences containing regions of partial homology, assembling the polynucleotides to form at least one polynucleotide and screening the polynucleotides for the production of polypeptide(s) having a useful property.

In yet another aspect, this invention is serviceable for analyzing and cataloguing, with respect to any molecular property (e.g. an enzymatic activity) or combination of properties allowed by current technology, the effects of any mutational change achieved (including particularly saturation mutagenesis). Thus, a comprehensive method is provided for determining the effect of changing each amino acid in a parental polypeptide into each of at least 19 possible substitutions. This allows each amino acid in a parental polypeptide to be characterized and catalogued according to its spectrum of potential effects on a measurable property of the polypeptide.

In one aspect, an intron may be introduced into a chimeric progeny molecule by way of a nucleic acid building block. Introns often have consensus sequences at both termini in order to render them operational. In addition to enabling gene splicing, introns may serve an additional purpose by providing sites of homology to other nucleic acids to enable homologous recombination. For this purpose, and potentially others, it may be sometimes desirable to generate a large nucleic acid building block for introducing an intron. If the size is overly large easily generating by direct chemical synthesis of two single stranded oligos, such a specialized nucleic acid building block may also be generated by direct chemical synthesis of more than two single stranded oligos or by using a polymerase-based amplification reaction The mutually compatible ligatable ends of the nucleic acid building blocks to be assembled are considered to be "serviceable" for this type of ordered assembly if they enable the building blocks to be coupled in predetermined orders. Thus, in one aspect, the overall assembly order in which the nucleic acid building blocks can be coupled is specified by the design of the ligatable ends and, if more than one assembly step is to be used, then the overall assembly order in which the nucleic acid building blocks can be coupled is also specified by the sequential order of the assembly step(s). In a one aspect of the invention, the annealed building pieces are treated with an enzyme, such as a ligase (e.g., T4 DNA ligase) to achieve covalent bonding of the building pieces.

Coupling can occur in a manner that does not make use of every nucleotide in a participating overhang. The coupling is particularly lively to survive (e.g. in a transformed host) if the coupling reinforced by treatment with a ligase enzyme to form what may be referred to as a "gap ligation" or a "gapped ligation". This type of coupling can contribute to generation of unwanted background product(s), but it can also be used advantageously increase the diversity of the progeny library generated by the designed ligation reassembly. Certain overhangs are able to undergo self-coupling to form a palindromic coupling. A coupling is strengthened substantially if it is reinforced by treatment with a ligase enzyme. Lack of 5' phosphates on these overhangs can be used advantageously to prevent this type of palindromic self-ligation. Accordingly, this invention provides that nucleic acid building blocks can be chemically made (or ordered) that lack a 5' phosphate group. Alternatively, they can be removed, e.g. by treatment with a phosphatase enzyme, such as a calf intestinal alkaline phosphatase (CIAP), in order to prevent palindromic self-ligations in ligation reassembly processes.

In a another aspect, the design of nucleic acid building blocks is obtained upon analysis of the sequences of a set of progenitor nucleic acid templates that serve as a basis for producing a progeny set of finalized chimeric nucleic acid molecules. These progenitor nucleic acid templates thus serve as a source of sequence information that aids in the design of the nucleic acid building blocks that are to be mutagenized, i.e. chimerized or shuffled.

In one exemplification, the invention provides for the chimerization of a family of related genes and their encoded family of related products. In a particular exemplification, the encoded products are enzymes. The isomerases, e.g., racemases, e.g., amino acid racemases, alanine racemases, and/or epimerases of the present invention can be mutagenized in accordance with the methods described herein.

Thus according to one aspect of the invention, the sequences of a plurality of progenitor nucleic acid templates (e.g., polynucleotides of The invention) are aligned in order to select one or more demarcation points, which demarcation points can be located at an area of homology. The demarcation points can be used to delineate the boundaries of nucleic acid building blocks to be generated. Thus, the demarcation points identified and selected in the progenitor molecules serve as potential chimerization points in the assembly of the progeny molecules.

Typically a serviceable demarcation point is an area of homology (comprised of at least one homologous nucleotide base) shared by at least two progenitor templates, but the demarcation point can be an area of homology that is shared by at least half of the progenitor templates, at least two thirds of the progenitor templates, at least three fourths of the progenitor templates and preferably at almost all of the progenitor templates. Even more preferably still a serviceable demarcation point is an area of homology that is shared by all of the progenitor templates.

In a one aspect, the gene reassembly process is performed exhaustively in order to generate an exhaustive library. In other words, all possible ordered combinations of the nucleic acid building blocks are represented in the set of finalized chimeric nucleic acid molecules. At the same time, the assembly order (i.e. the order of assembly of each building block in the 5' to 3 sequence of each finalized chimeric nucleic acid) in each combination is by design (or non-stochastic). Because of the non-stochastic nature of the method, the possibility of unwanted side products is greatly reduced.

In another aspect, the method provides that the gene reassembly process is performed systematically, for example to generate a systematically compartmentalized library, with compartments that can be screened systematically, e.g., one by one. In other words the invention provides that, through the selective and judicious use of specific nucleic acid building blocks, coupled with the selective and judicious use of sequentially stepped assembly reactions, an experimental design can be achieved where specific sets of progeny products are made in each of several reaction vessels. This allows a systematic examination and screening procedure to be performed. Thus, it allows a potentially very large number of progeny molecules to be examined systematically in smaller groups.

Because of its ability to perform chimerizations in a manner that is highly flexible yet exhaustive and systematic as well, particularly when there is a low level of homology among the progenitor molecules, the instant invention provides for the generation of a library (or set) comprised of a large number of progeny molecules. Because of the non-stochastic nature of the instant gene reassembly invention, the progeny molecules generated preferably comprise a library of finalized chimeric nucleic acid molecules having an overall assembly order that is chosen by design. In a particularly aspect, such a generated library is comprised of greater than $10^3$ to greater than $10^{1000}$ different progeny molecular species.

In one aspect, a set of finalized chimeric nucleic acid molecules, produced as described is comprised of a polynucleotide encoding a polypeptide. According to one aspect, this polynucleotide is a gene, which may be a man-made gene. According to another aspect, this polynucleotide is a gene pathway, which may be a man-made gene pathway. The invention provides that one or more man-made genes generated by the invention may be incorporated into a man-made gene pathway, such as pathway operable in a eukaryotic organism (including a plant).

In another exemplification, the synthetic nature of the step in which the building blocks are generated allows the design and introduction of nucleotides (e.g., one or more nucleotides, which may be, for example, codons or introns or regulatory sequences) that can later be in one aspect removed in an in vitro process (e.g., by mutagenesis) or in an in vivo process (e.g., by utilizing the gene splicing ability of a host organism). It is appreciated that in many instances the introduction of these nucleotides may also be desirable for many other reasons in addition to the potential benefit of creating a serviceable demarcation point.

Thus, according to another aspect, the invention provides that a nucleic acid building block can be used to introduce an intron. Thus, the invention provides that functional introns may be introduced into a man-made gene of the invention. The invention also provides that functional introns may be introduced into a man-made gene pathway of the invention. Accordingly, the invention provides for the generation of a chimeric polynucleotide that is a man-made gene containing one (or more) artificially introduced intron(s).

Accordingly, the invention also provides for the generation of a chimeric polynucleotide that is a man-made gene pathway containing one (or more) artificially introduced intron(s). Preferably, the artificially introduced intron(s) are functional in one or more host cells for gene splicing much in the way that naturally-occurring introns serve functionally in gene splicing. The invention provides a process of producing man-made intron-containing polynucleotides to be introduced into host organisms for recombination and/or splicing.

A man-made gene produced using the invention can also serve as a substrate for recombination with another nucleic acid. Likewise, a man-made gene pathway produced using the invention can also serve as a substrate for recombination with another nucleic acid. In a one aspect, the recombination is facilitated by, or occurs at, areas of homology between the man-made, intron-containing gene and a nucleic acid, which serves as a recombination partner. In one aspect, the recombination partner may also be a nucleic acid generated by the invention, including a man-made gene or a man-made gene pathway. Recombination may be facilitated by or may occur at areas of homology that exist at the one (or more) artificially introduced intron(s) in the man-made gene.

The synthetic gene reassembly method of the invention utilizes a plurality of nucleic acid building blocks, each of which preferably has two ligatable ends. The two ligatable ends on each nucleic acid building block may be two blunt ends (i.e. each having an overhang of zero nucleotides), or preferably one blunt end and one overhang, or more preferably still two overhangs.

A useful overhang for this purpose may be a 3' overhang or a 5' overhang. Thus, a nucleic acid building block may have a 3' overhang or alternatively a 5' overhang or alternatively two 3' overhangs or alternatively two 5' overhangs. The overall order in which the nucleic acid building blocks are assembled to form a finalized chimeric nucleic acid molecule is determined by purposeful experimental design and is not random.

In one aspect, a nucleic acid building block is generated by chemical synthesis of two single-stranded nucleic acids (also referred to as single-stranded oligos) and contacting them so as to allow them to anneal to form a double-stranded nucleic acid building block.

A double-stranded nucleic acid building block can be of variable size. The sizes of these building blocks can be small or large. Exemplary sizes for building block range from 1 base pair (not including any overhangs) to 100,000 base pairs (not including any overhangs). Other exemplary size ranges are also provided, which have lower limits of from 1 bp to 10,000 bp (including every integer value in between) and upper limits of from 2 bp to 100,000 bp (including every integer value in between).

Many methods exist by which a double-stranded nucleic acid building block can be generated that is serviceable for the invention; and these are known in the art and can be readily performed by the skilled artisan.

According to one aspect, a double-stranded nucleic acid building block is generated by first generating two single stranded nucleic acids and allowing them to anneal to form a double-stranded nucleic acid building block. The two strands of a double-stranded nucleic acid building block may be complementary at every nucleotide apart from any that form an overhang; thus containing no mismatches, apart from any overhang(s). According to another aspect, the two strands of a double-stranded nucleic acid building block are complementary at fewer than every nucleotide apart from any that form an overhang. Thus, according to this aspect, a double-stranded nucleic acid building block can be used to introduce codon degeneracy. The codon degeneracy can be introduced using the site-saturation mutagenesis described herein, using one or more N,N,G/T cassettes or alternatively using one or more N,N,N cassettes.

The in vivo recombination method of the invention can be performed blindly on a pool of unknown hybrids or alleles of a specific polynucleotide or sequence. However, it is not necessary to know the actual DNA or RNA sequence of the specific polynucleotide.

The approach of using recombination within a mixed population of genes can be useful for the generation of any useful proteins, for example, interleukin I, antibodies, tPA and growth hormone. This approach may be used to generate proteins having altered specificity or activity. The approach may also be useful for the generation of hybrid nucleic acid sequences, for example, promoter regions, introns, exons, enhancer sequences, 31 untranslated regions or 51 untranslated regions of genes. Thus this approach may be used to generate genes having increased rates of expression. This approach may also be useful in the study of repetitive DNA sequences. Finally, this approach may be useful to mutate ribozymes or aptamers.

In one aspect the invention described herein is directed to the use of repeated cycles of reductive reassortment, recombination and selection which allow for the directed molecular evolution of highly complex linear sequences, such as DNA, RNA or proteins thorough recombination.

Optimized Directed Evolution System

The invention provides a non-stochastic gene modification system termed "optimized directed evolution system" to generate polypeptides, e.g., isomerases, e.g., racemases, e.g., amino acid racemases, alanine racemases, and/or epimerases, or antibodies of the invention, with new or altered properties. Optimized directed evolution is directed to the use of repeated cycles of reductive reassortment, recombination and selection that allow for the directed molecular evolution of nucleic acids through recombination. Optimized directed evolution allows generation of a large population of evolved chimeric sequences, wherein the generated population is significantly enriched for sequences that have a predetermined number of crossover events.

A crossover event is a point in a chimeric sequence where a shift in sequence occurs from one parental variant to another parental variant. Such a point is normally at the juncture of where oligonucleotides from two parents are ligated together to form a single sequence. This method allows calculation of the correct concentrations of oligonucleotide sequences so that the final chimeric population of sequences is enriched for the chosen number of crossover events. This provides more control over choosing chimeric variants having a predetermined number of crossover events.

In addition, this method provides a convenient means for exploring a tremendous amount of the possible protein variant space in comparison to other systems. Previously, if one generated, for example, $10^{13}$ chimeric molecules during a reaction, it would be extremely difficult to test such a high number of chimeric variants for a particular activity. Moreover, a significant portion of the progeny population would have a very high number of crossover events which resulted in proteins that were less likely to have increased levels of a particular activity. By using these methods, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

One method for creating a chimeric progeny polynucleotide sequence is to create oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. Additional information can also be found, e.g., in U.S. Ser. No. 09/332,835; U.S. Pat. No. 6,361,974.

The number of oligonucleotides generated for each parental variant bears a relationship to the total number of resulting crossovers in the chimeric molecule that is ultimately created. For example, three parental nucleotide sequence variants might be provided to undergo a ligation reaction in order to find a chimeric variant having, for example, greater activity at high temperature. As one example, a set of 50 oligonucleotide sequences can be generated corresponding to each portions of each parental variant. Accordingly, during the ligation reassembly process there could be up to 50 crossover events within each of the chimeric sequences. The probability that each of the generated chimeric polynucleotides will contain oligonucleotides from each parental variant in alternating order is very low. If each oligonucleotide fragment is present in the ligation reaction in the same molar quantity it is likely that in some positions oligonucleotides from the same parental polynucleotide will ligate next to one another and thus not result in a crossover event. If the concentration of each oligonucleotide from each parent is kept constant during any ligation step in this example, there is a ⅓ chance (assuming 3 parents) that an oligonucleotide from the same parental variant will ligate within the chimeric sequence and produce no crossover.

Accordingly, a probability density function (PDF) can be determined to predict the population of crossover events that are likely to occur during each step in a ligation reaction given a set number of parental variants, a number of oligonucleotides corresponding to each variant, and the concentrations of each variant during each step in the ligation reaction. The statistics and mathematics behind determining the PDF is described below. By utilizing these methods, one can calculate such a probability density function, and thus enrich the chimeric progeny population for a predetermined number of crossover events resulting from a particular ligation reaction. Moreover, a target number of crossover events can be predetermined, and the system then programmed to calculate the starting quantities of each parental oligonucleotide during each step in the ligation reaction to result in a probability density function that centers on the predetermined number of crossover events. These methods are directed to the use of repeated cycles of reductive reassortment, recombination and selection that allow for the directed molecular evolution of a nucleic acid encoding a polypeptide through recombination. This system allows generation of a large population of evolved chimeric sequences, wherein the generated population is significantly enriched for sequences that have a predetermined number of crossover events. A crossover event is a point in a chimeric sequence where a shift in sequence occurs from one parental variant to another parental variant. Such a point is normally at the juncture of where oligonucleotides from two parents are ligated together to form a single sequence. The method allows calculation of the correct concentrations of oligonucleotide sequences so that the final chimeric population of sequences is enriched for the chosen number of crossover events. This provides more control over choosing chimeric variants having a predetermined number of crossover events.

In addition, these methods provide a convenient means for exploring a tremendous amount of the possible protein variant space in comparison to other systems. By using the methods described herein, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

In one aspect, the method creates a chimeric progeny polynucleotide sequence by creating oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. See also U.S. Ser. No. 09/332,835.

Determining Crossover Events

Aspects of the invention include a system and software that receive a desired crossover probability density function (PDF), the number of parent genes to be reassembled, and the number of fragments in the reassembly as inputs. The output of this program is a "fragment PDF" that can be used to determine a recipe for producing reassembled genes, and the estimated crossover PDF of those genes. The processing described herein is preferably performed in MATLAB™ (The Mathworks, Natick, Mass.) a programming language and development environment for technical computing.

Iterative Processes

In practicing the invention, these processes can be iteratively repeated. For example, a nucleic acid (or, the nucleic acid) responsible for an altered or new isomerase, e.g., racemase, e.g., amino acid racemase, alanine racemase, and/or epimerase phenotype is identified, re-isolated, again modified, re-tested for activity. This process can be iteratively repeated until a desired phenotype is engineered. For example, an entire biochemical anabolic or catabolic pathway can be engineered into a cell, including, e.g., isomerase, e.g., racemase, e.g., amino acid racemase, alanine racemase, and/or epimerase activity.

Similarly, if it is determined that a particular oligonucleotide has no affect at all on the desired trait (e.g., a new isomerase, e.g., racemase, e.g., amino acid racemase, alanine racemase, and/or epimerase phenotype), it can be removed as a variable by synthesizing larger parental oligonucleotides that include the sequence to be removed. Since incorporating the sequence within a larger sequence prevents any crossover events, there will no longer be any variation of this sequence in the progeny polynucleotides. This iterative practice of determining which oligonucleotides are most related to the desired trait, and which are unrelated, allows more efficient exploration all of the possible protein variants that might be provide a particular trait or activity.

In Vivo Shuffling

In vivo shuffling of molecules is use in methods of the invention that provide variants of polypeptides of the invention, e.g., antibodies, isomerases, e.g., racemases, e.g., amino acid racemases, alanine racemases, and/or epimerases, and the like. In vivo shuffling can be performed utilizing the natural property of cells to recombine multimers. While recombination in vivo has provided the major natural route to molecular diversity, genetic recombination remains a relatively complex process that involves 1) the recognition of homologies; 2) strand cleavage, strand invasion, and metabolic steps leading to the production of recombinant chiasma; and finally 3) the resolution of chiasma into discrete recombined molecules. The formation of the chiasma requires the recognition of homologous sequences.

In another aspect, the invention includes a method for producing a hybrid polynucleotide from at least a first polynucleotide and a second polynucleotide. The invention can be used to produce a hybrid polynucleotide by introducing at least a first polynucleotide and a second polynucleotide which share at least one region of partial sequence homology into a suitable host cell. The regions of partial sequence homology promote processes which result in sequence reorganization producing a hybrid polynucleotide. The term "hybrid polynucleotide", as used herein, is any nucleotide sequence which results from the method of the present invention and contains sequence from at least two original polynucleotide sequences. Such hybrid polynucleotides can result from intermolecular recombination events which promote sequence integration between DNA molecules. In addition, such hybrid polynucleotides can result from intramolecular reductive reassortment processes which utilize repeated sequences to alter a nucleotide sequence within a DNA molecule.

In vivo reassortment is focused on "inter-molecular" processes collectively referred to as "recombination" which in bacteria, is generally viewed as a "RecA-dependent" phenomenon. The invention can rely on recombination processes of a host cell to recombine and re-assort sequences, or the cells' ability to mediate reductive processes to decrease the complexity of quasi-repeated sequences in the cell by deletion. This process of "reductive reassortment" occurs by an "intra-molecular", RecA-independent process.

Therefore, in another aspect of the invention, novel polynucleotides can be generated by the process of reductive reassortment. The method involves the generation of constructs containing consecutive sequences (original encoding sequences), their insertion into an appropriate vector and their subsequent introduction into an appropriate host cell. The reassortment of the individual molecular identities occurs by combinatorial processes between the consecutive sequences in the construct possessing regions of homology, or between quasi-repeated units. The reassortment process recombines and/or reduces the complexity and extent of the repeated sequences and results in the production of novel molecular species. Various treatments may be applied to enhance the rate of reassortment. These could include treatment with ultra-violet light, or DNA damaging chemicals and/or the use of host cell lines displaying enhanced levels of "genetic instability". Thus the reassortment process may involve homologous recombination or the natural property of quasi-repeated sequences to direct their own evolution.

Repeated or "quasi-repeated" sequences play a role in genetic instability. In the present invention, "quasi-repeats" are repeats that are not restricted to their original unit structure. Quasi-repeated units can be presented as an array of sequences in a construct; consecutive units of similar sequences. Once ligated, the junctions between the consecutive sequences become essentially invisible and the quasi-repetitive nature of the resulting construct is now continuous at the molecular level. The deletion process the cell performs to reduce the complexity of the resulting construct operates between the quasi-repeated sequences. The quasi-repeated units provide a practically limitless repertoire of templates upon which slippage events can occur. The constructs containing the quasi-repeats thus effectively provide sufficient molecular elasticity that deletion (and potentially insertion) events can occur virtually anywhere within the quasi-repetitive units.

When the quasi-repeated sequences are all ligated in the same orientation, for instance head to tail or vice versa, the cell cannot distinguish individual units. Consequently, the reductive process can occur throughout the sequences. In contrast, when for example, the units are presented head to head, rather than head to tail, the inversion delineates the endpoints of the adjacent unit so that deletion formation will favor the loss of discrete units. Thus, it is preferable with the present method that the sequences are in the same orientation. Random orientation of quasi-repeated sequences will result in the loss of reassortment efficiency, while consistent orientation of the sequences will offer the highest efficiency. However, while having fewer of the contiguous sequences in the same orientation decreases the efficiency, it may still provide sufficient elasticity for the effective recovery of novel molecules. Constructs can be made with the quasi-repeated sequences in the same orientation to allow higher efficiency.

Sequences can be assembled in a head to tail orientation using any of a variety of methods, including the following:
a) Primers that include a poly-A head and poly-T tail which when made single-stranded would provide orientation can be utilized. This is accomplished by having the first few bases of the primers made from RNA and hence easily removed RNaseH.
b) Primers that include unique restriction cleavage sites can be utilized. Multiple sites, a battery of unique sequences and repeated synthesis and ligation steps would be required.
c) The inner few bases of the primer could be thiolated and an exonuclease used to produce properly tailed molecules.

The recovery of the re-assorted sequences relies on the identification of cloning vectors with a reduced repetitive index (RI). The re-assorted encoding sequences can then be recovered by amplification. The products are re-cloned and expressed. The recovery of cloning vectors with reduced RI can be affected by:
1) The use of vectors only stably maintained when the construct is reduced in complexity.
2) The physical recovery of shortened vectors by physical procedures. In this case, the cloning vector would be recovered using standard plasmid isolation procedures and size fractionated on either an agarose gel, or column with a low molecular weight cut off utilizing standard procedures.
3) The recovery of vectors containing interrupted genes which can be selected when insert size decreases.
4) The use of direct selection techniques with an expression vector and the appropriate selection.

Encoding sequences (for example, genes) from related organisms may demonstrate a high degree of homology and encode quite diverse protein products. These types of sequences are particularly useful in the present invention as quasi-repeats. However, while the examples illustrated below demonstrate the reassortment of nearly identical original encoding sequences (quasi-repeats), this process is not limited to such nearly identical repeats.

The following example demonstrates a method of the invention. Encoding nucleic acid sequences (quasi-repeats) derived from three (3) unique species are described. Each sequence encodes a protein with a distinct set of properties. Each of the sequences differs by a single or a few base pairs at a unique position in the sequence. The quasi-repeated sequences are separately or collectively amplified and ligated into random assemblies such that all possible permutations and combinations are available in the population of ligated molecules. The number of quasi-repeat units can be controlled by the assembly conditions. The average number of quasi-repeated units in a construct is defined as the repetitive index (RI).

Once formed, the constructs may, or may not be size fractionated on an agarose gel according to published protocols, inserted into a cloning vector and transfected into an appropriate host cell. The cells are then propagated and "reductive reassortment" is effected. The rate of the reductive reassortment process may be stimulated by the introduction of DNA damage if desired. Whether the reduction in RI is mediated by deletion formation between repeated sequences by an "intra-molecular" mechanism, or mediated by recombination-like events through "inter-molecular" mechanisms is immaterial. The end result is a reassortment of the molecules into all possible combinations.

In one aspect (optionally), the method comprises the additional step of screening the library members of the shuffled pool to identify individual shuffled library members having the ability to bind or otherwise interact, or catalyze a particular reaction (e.g., such as catalytic domain of an enzyme) with a predetermined macromolecule, such as for example a proteinaceous receptor, an oligosaccharide, virion, or other predetermined compound or structure.

The polypeptides that are identified from such libraries can be used for therapeutic, diagnostic, research and related purposes (e.g., catalysts, solutes for increasing osmolarity of an aqueous solution and the like) and/or can be subjected to one or more additional cycles of shuffling and/or selection.

In another aspect, it is envisioned that prior to or during recombination or reassortment, polynucleotides generated by the method of the invention can be subjected to agents or processes which promote the introduction of mutations into the original polynucleotides. The introduction of such mutations would increase the diversity of resulting hybrid polynucleotides and polypeptides encoded therefrom. The agents or processes which promote mutagenesis can include, but are not limited to: (+)-CC-1065, or a synthetic analog such as (+)-CC-1065-(N3-Adenine (See Sun and Hurley, (1992); an N-acetylated or deacetylated 4'-fluoro-4-aminobiphenyl adduct capable of inhibiting DNA synthesis (See, for example, van de Poll et al. (1992)); or a N-acetylated or deacetylated 4-aminobiphenyl adduct capable of inhibiting DNA synthesis (See also, van de Poll et al. (1992), pp. 751-758); trivalent chromium, a trivalent chromium salt, a polycyclic aromatic hydrocarbon (PAH) DNA adduct capable of inhibiting DNA replication, such as 7-bromomethyl-benz[α] anthracene ("BMA"), tris(2,3-dibromopropyl)phosphate ("Tris-BP"), 1,2-dibromo-3-chloropropane ("DBCP"), 2-bromoacrolein (2BA), benzo[α]pyrene-7,8-dihydrodiol-9-10-epoxide ("BPDE"), a platinum(II) halogen salt, N-hydroxy-2-amino-3-methylimidazo[4,5-f]-quinoline ("N-hydroxy-IQ") and N-hydroxy-2-amino-1-methyl-6-phenylimidazo[4,5f]-pyridine ("N-hydroxy-PhIP"). Exemplary means for slowing or halting PCR amplification consist of UV light (+)-CC-1065 and (+)-CC-1065-(N3-Adenine). Particularly encompassed means are DNA adducts or polynucleotides comprising the DNA adducts from the polynucleotides or polynucleotides pool, which can be released or removed by a process including heating the solution comprising the polynucleotides prior to further processing.

In another aspect the invention is directed to a method of producing recombinant proteins having biological activity by treating a sample comprising double-stranded template polynucleotides encoding a wild-type protein under conditions according to the invention which provide for the production of hybrid or re-assorted polynucleotides.

Producing Sequence Variants

The invention also provides additional methods for making sequence variants of the nucleic acid (e.g., isomerase, e.g., racemase, e.g., amino acid racemase, alanine racemase, and/or epimerase) sequences of the invention. The invention also provides additional methods for isolating isomerases, e.g., racemases, e.g., amino acid racemases, alanine racemases, and/or epimerases using the nucleic acids and polypeptides of the invention. In one aspect, the invention provides for variants of an isomerase, e.g., racemase, e.g., amino acid racemase, alanine racemase, and/or epimerase coding sequence (e.g., a gene, cDNA or message) of the invention, which can be altered by any means, including, e.g., random or stochastic methods, or, non-stochastic, or "directed evolution," methods, as described above.

The isolated variants may be naturally occurring. Variant can also be created in vitro. Variants may be created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures. Other methods of making variants are also familiar to those skilled in the art. These include procedures in which nucleic acid sequences obtained from natural isolates are modified to generate new nucleic acids which encode polypeptides having characteristics which enhance their value in industrial, medical, laboratory (research), pharmaceutical, food and feed and food and feed supplement processing and other applications and processes. In such procedures, a large number of variant sequences having one or more nucleotide differences with respect to the sequence obtained from the natural isolate are generated and characterized. These nucleotide differences can result in amino acid changes with respect to the polypeptides encoded by the nucleic acids from the natural isolates.

For example, variants may be created using error prone PCR. In error prone PCR, PCR is performed under conditions where the copying fidelity of the DNA polymerase is low, such that a high rate of point mutations is obtained along the entire length of the PCR product. Error prone PCR is described, e.g., in Leung, D. W., et al., Technique, 1:11-15, 1989) and Caldwell, R. C. & Joyce G. F., PCR Methods Applic., 2:28-33, 1992. Briefly, in such procedures, nucleic acids to be mutagenized are mixed with PCR primers, reaction buffer, $MgCl_2$, $MnCl_2$, Taq polymerase and an appropriate concentration of dNTPs for achieving a high rate of point mutation along the entire length of the PCR product. For example, the reaction may be performed using 20 fmoles of nucleic acid to be mutagenized, 30 pmole of each PCR primer, a reaction buffer comprising 50 mM KCl, 10 mM Tris HCl (pH 8.3) and 0.01% gelatin, 7 mM $MgCl_2$, 0.5 mM $MnCl_2$, 5 units of Taq polymerase, 0.2 mM dGTP, 0.2 mM dATP, 1 mM dCTP, and 1 mM dTTP. PCR may be performed for 30 cycles of 94° C. for 1 min, 45° C. for 1 min, and 72° C. for 1 min. However, it will be appreciated that these parameters may be varied as appropriate. The mutagenized nucleic acids are cloned into an appropriate vector and the activities of the polypeptides encoded by the mutagenized nucleic acids are evaluated.

Variants may also be created using oligonucleotide directed mutagenesis to generate site-specific mutations in any cloned DNA of interest. Oligonucleotide mutagenesis is described, e.g., in Reidhaar-Olson (1988) Science 241:53-57. Briefly, in such procedures a plurality of double stranded oligonucleotides bearing one or more mutations to be introduced into the cloned DNA are synthesized and inserted into the cloned DNA to be mutagenized. Clones containing the mutagenized DNA are recovered and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, e.g., U.S. Pat. No. 5,965,408.

Still another method of generating variants is sexual PCR mutagenesis. In sexual PCR mutagenesis, forced homologous recombination occurs between DNA molecules of different but highly related DNA sequence in vitro, as a result of random fragmentation of the DNA molecule based on sequence homology, followed by fixation of the crossover by primer extension in a PCR reaction. Sexual PCR mutagenesis is described, e.g., in Stemmer (1994) Proc. Natl. Acad. Sci. USA 91:10747-10751. Briefly, in such procedures a plurality of nucleic acids to be recombined are digested with DNase to generate fragments having an average size of 50-200 nucleotides. Fragments of the desired average size are purified and resuspended in a PCR mixture. PCR is conducted under conditions which facilitate recombination between the nucleic acid fragments. For example, PCR may be performed by resuspending the purified fragments at a concentration of 10-30 ng/μl in a solution of 0.2 mM of each dNTP, 2.2 mM $MgCl_2$, 50 mM KCL, 10 mM Tris HCl, pH 9.0, and 0.1% Triton X-100. 2.5 units of Taq polymerase per 100:1 of reaction mixture is added and PCR is performed using the following regime: 94° C. for 60 seconds, 94° C. for 30 seconds, 50-55° C. for 30 seconds, 72° C. for 30 seconds (30-45 times) and 72° C. for 5 minutes. However, it will be appreciated that these parameters may be varied as appropriate. In some aspects, oligonucleotides may be included in the PCR reactions. In other aspects, the Klenow fragment of DNA polymerase I may be used in a first set of PCR reactions and Taq polymerase may be used in a subsequent set of PCR reactions. Recombinant sequences are isolated and the activities of the polypeptides they encode are assessed.

Variants may also be created by in vivo mutagenesis. In some aspects, random mutations in a sequence of interest are generated by propagating the sequence of interest in a bacterial strain, such as an *E. coli* strain, which carries mutations in one or more of the DNA repair pathways. Such "mutator" strains have a higher random mutation rate than that of a wild-type parent. Propagating the DNA in one of these strains will eventually generate random mutations within the DNA. Mutator strains suitable for use for in vivo mutagenesis are described in PCT Publication No. WO 91/16427, published Oct. 31, 1991, entitled "Methods for Phenotype Creation from Multiple Gene Populations".

Variants may also be generated using cassette mutagenesis. In cassette mutagenesis a small region of a double stranded DNA molecule is replaced with a synthetic oligonucleotide "cassette" that differs from the native sequence. The oligonucleotide often contains completely and/or partially randomized native sequence.

Recursive ensemble mutagenesis may also be used to generate variants. Recursive ensemble mutagenesis is an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described in Arkin, A. P. and Youvan, D. C., PNAS, USA, 89:7811-7815, 1992.

In some aspects, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described in Delegrave, S, and Youvan, D. C., Biotechnology Research, 11:1548-1552, 1993. Random and site-directed mutagenesis are described in Arnold, F. H., Current Opinion in Biotechnology, 4:450-455, 1993.

In some aspects, the variants are created using shuffling procedures wherein portions of a plurality of nucleic acids which encode distinct polypeptides are fused together to create chimeric nucleic acid sequences which encode chimeric polypeptides as described in U.S. Pat. No. 5,965,408, filed Jul. 9, 1996, entitled, "Method of DNA Reassembly by Interrupting Synthesis" and U.S. Pat. No. 5,939,250, filed May 22, 1996, entitled, "Production of Enzymes Having Desired Activities by Mutagenesis.

The variants of the polypeptides of the invention may be variants in which one or more of the amino acid residues of the polypeptides of the invention are substituted with a conserved or non-conserved amino acid residue (preferably a conserved amino acid residue) and such substituted amino acid residue may or may not be one encoded by the genetic code.

Conservative substitutions are those that substitute a given amino acid in a polypeptide by another amino acid of like characteristics. Typically seen as conservative substitutions are the following replacements: replacements of an aliphatic amino acid such as Alanine, Valine, Leucine and Isoleucine with another aliphatic amino acid; replacement of a Serine with a Threonine or vice versa; replacement of an acidic residue such as Aspartic acid and Glutamic acid with another acidic residue; replacement of a residue bearing an amide group, such as Asparagine and Glutamine, with another residue bearing an amide group; exchange of a basic residue such as Lysine and Arginine with another basic residue; and replacement of an aromatic residue such as Phenylalanine, Tyrosine with another aromatic residue.

Other variants are those in which one or more of the amino acid residues of the polypeptides of the invention includes a substituent group.

Still other variants are those in which the polypeptide is associated with another compound, such as a compound to increase the half-life of the polypeptide (for example, polyethylene glycol).

Additional variants are those in which additional amino acids are fused to the polypeptide, such as a leader sequence, a secretory sequence, a proprotein sequence or a sequence which facilitates purification, enrichment, or stabilization of the polypeptide.

In some aspects, the fragments, derivatives and analogs retain the same biological function or activity as the polypeptides of the invention and sequences substantially identical thereto. In other aspects, the fragment, derivative, or analog includes a proprotein, such that the fragment, derivative, or analog can be activated by cleavage of the proprotein portion to produce an active polypeptide.

Optimizing Codons to Achieve High Levels of Protein Expression in Host Cells

The invention provides methods for modifying an isomerase-, e.g., a racemase-, e.g., an amino acid racemase-, an alanine racemase-, and/or an epimerase-isomerase-, e.g., racemase-, e.g., amino acid racemase-, alanine racemase-, and/or epimerase-encoding nucleic acids to modify codon usage. In one aspect, the invention provides methods for modifying codons in a nucleic acid encoding an isomerase, e.g., racemase, e.g., amino acid racemase, alanine racemase, and/or epimerase to increase or decrease its expression in a host cell. The invention also provides nucleic acids encoding an isomerase, e.g., racemase, e.g., amino acid racemase, alanine racemase, and/or epimerase modified to increase its expression in a host cell, enzymes so modified, and methods of making the modified enzymes. The method comprises identifying a "non-preferred" or a "less preferred" codon in an isomerase-, e.g., racemase-, e.g., amino acid racemase-, alanine racemase-, and/or epimerase-encoding nucleic acid and replacing one or more of these non-preferred or less preferred codons with a "preferred codon" encoding the same amino acid as the replaced codon and at least one non-preferred or less preferred codon in the nucleic acid has been replaced by a preferred codon encoding the same amino acid. A preferred codon is a codon over-represented in coding sequences in genes in the host cell and a non-preferred or less preferred codon is a codon under-represented in coding sequences in genes in the host cell.

Host cells for expressing the nucleic acids, expression cassettes and vectors of the invention include bacteria, yeast, fungi, plant cells, insect cells and mammalian cells. Thus, the invention provides methods for optimizing codon usage in all of these cells, codon-altered nucleic acids and polypeptides made by the codon-altered nucleic acids. Exemplary host cells include gram negative bacteria, such as *Escherichia coli* and *Pseudomonas fluorescens*; gram positive bacteria, such as *Lactobacillus gasseri, Lactococcus lactis, Lactococcus cremoris, Bacillus subtilis*. Exemplary host cells also include eukaryotic organisms, e.g., various yeast, such as *Saccharomyces* sp., including *Saccharomyces cerevisiae, Schizosaccharomyces pombe, Pichia pastoris,* and *Kluyveromyces lactis, Hansenula polymorpha, Aspergillus niger,* and mammalian cells and cell lines and insect cells and cell lines. Other exemplary host cells include bacterial cells, such as *E. coli, Streptomyces, Bacillus subtilis, Bacillus cereus, Salmonella typhimurium* and various species within the genera *Pseudomonas, Streptomyces* and *Staphylococcus*, fungal cells, such as *Aspergillus*, yeast such as any species of *Pichia, Saccharomyces, Schizosaccharomyces, Schwanniomyces,* including *Pichia pastoris, Saccharomyces cerevisiae,* or *Schizosaccharomyces pombe*, insect cells such as *Drosophila* S2 and *Spodoptera* Sf9, animal cells such as CHO, COS or Bowes melanoma and adenoviruses. The selection of an appropriate host is within the abilities of those skilled in the art. Thus, the invention also includes nucleic acids and polypeptides optimized for expression in these organisms and species.

For example, the codons of a nucleic acid encoding an isomerase, e.g., racemase, e.g., amino acid racemase, alanine racemase, and/or epimerase isolated from a bacterial cell are modified such that the nucleic acid is optimally expressed in a bacterial cell different from the bacteria from which the isomerase, e.g., racemase, e.g., amino acid racemase, alanine racemase, and/or epimerase was derived, a yeast, a fungi, a plant cell, an insect cell or a mammalian cell. Methods for optimizing codons are well known in the art, see, e.g., U.S. Pat. No. 5,795,737; Baca (2000) Int. J. Parasitol. 30:113-118; Hale (1998) Protein Expr. Purif. 12:185-188; Narum (2001) Infect. Immun. 69:7250-7253. See also Narum (2001) Infect. Immun. 69:7250-7253, describing optimizing codons in mouse systems; Outchkourov (2002) Protein Expr. Purif. 24:18-24, describing optimizing codons in yeast; Feng (2000) Biochemistry 39:15399-15409, describing optimizing codons in *E. coli*; Humphreys (2000) Protein Expr. Purif. 20:252-264, describing optimizing codon usage that affects secretion in *E. coli*.

Transgenic Non-Human Animals

The invention provides transgenic non-human animals comprising a nucleic acid, a polypeptide (e.g., an isomerase, e.g., racemase, e.g., amino acid racemase, alanine racemase, and/or epimerase), an expression cassette or vector or a transfected or transformed cell of the invention. The invention also provides methods of making and using these transgenic non-human animals.

The transgenic non-human animals can be, e.g., goats, rabbits, sheep, pigs, cows, rats, horses, dogs, fish and mice, comprising the nucleic acids of the invention. These animals can be used, e.g., as in vivo models to study isomerase, e.g., racemase, e.g., amino acid racemase, alanine racemase, and/ or epimerase activity, or, as models to screen for agents that change the isomerase, e.g., racemase, e.g., amino acid racemase, alanine racemase, and/or epimerase activity in vivo. The coding sequences for the polypeptides to be expressed in the transgenic non-human animals can be designed to be constitutive, or, under the control of tissue-specific, developmental-specific or inducible transcriptional regulatory factors. Transgenic non-human animals can be designed and generated using any method known in the art; see, e.g., U.S. Pat. Nos. 6,211,428; 6,187,992; 6,156,952; 6,118,044; 6,111, 166; 6,107,541; 5,959,171; 5,922,854; 5,892,070; 5,880,327; 5,891,698; 5,639,940; 5,573,933; 5,387,742; 5,087,571, describing making and using transformed cells and eggs and transgenic mice, rats, rabbits, sheep, pigs, chickens, goats, fish and cows. See also, e.g., Pollock (1999) J. Immunol. Methods 231:147-157, describing the production of recombinant proteins in the milk of transgenic dairy animals; Baguisi (1999) Nat. Biotechnol. 17:456-461, demonstrating the production of transgenic goats. U.S. Pat. No. 6,211,428, describes making and using transgenic non-human mammals which express in their brains a nucleic acid construct comprising a DNA sequence. U.S. Pat. No. 5,387,742, describes injecting cloned recombinant or synthetic DNA sequences into fertilized mouse eggs, implanting the injected eggs in pseudo-pregnant females, and growing to term transgenic mice whose cells express proteins related to the pathology of Alzheimer's disease. U.S. Pat. No. 6,187,992, describes making and using a transgenic mouse whose genome comprises a disruption of the gene encoding amyloid precursor protein (APP).

"Knockout animals" can also be used to practice the methods of the invention. For example, in one aspect, the transgenic or modified animals of the invention comprise a "knockout animal," e.g., a "knockout mouse," engineered not to express an endogenous gene, which is replaced with a gene expressing an isomerase, e.g., racemase, e.g., amino acid racemase, alanine racemase, and/or epimerase of the invention, or, a fusion protein comprising an isomerase, e.g., racemase, e.g., amino acid racemase, alanine racemase, and/or epimerase of the invention.

Transgenic Plants and Seeds

The invention provides transgenic plants and seeds comprising a nucleic acid, a polypeptide (e.g., an isomerase, e.g., racemase, e.g., amino acid racemase, alanine racemase, and/ or epimerase), an expression cassette or vector or a transfected or transformed cell of the invention. The invention also provides plant products or byproducts, e.g., fruits, oils, seeds, leaves, extracts and the like, including any plant part, comprising a nucleic acid and/or a polypeptide (e.g., an isomerase, e.g., racemase, e.g., amino acid racemase, alanine racemase, and/or epimerase) of the invention, e.g., wherein the nucleic acid or polypeptide of the invention is heterologous to the plant, plant part, seed etc. The transgenic plant (which includes plant parts, fruits, seeds etc.) can be dicotyledonous (a dicot) or monocotyledonous (a monocot). The invention also provides methods of making and using these transgenic plants and seeds. The transgenic plant or plant cell expressing a polypeptide of the present invention may be constructed in accordance with any method known in the art. See, for example, U.S. Pat. No. 6,309,872.

Nucleic acids and expression constructs of the invention can be introduced into a plant cell by any means. For example, nucleic acids or expression constructs can be introduced into the genome of a desired plant host, or, the nucleic acids or expression constructs can be episomes. Introduction into the genome of a desired plant can be such that the host's isomerase, e.g., racemase, e.g., amino acid racemase, alanine racemase, and/or epimerase production is regulated by endogenous transcriptional or translational control elements. The invention also provides "knockout plants" where insertion of gene sequence by, e.g., homologous recombination, has disrupted the expression of the endogenous gene. Means to generate "knockout" plants are well-known in the art, see, e.g., Strepp (1998) Proc Natl. Acad. Sci. USA 95:4368-4373; Miao (1995) Plant J 7:359-365. See discussion on transgenic plants, below.

The nucleic acids of the invention can be used to confer desired traits on essentially any plant, e.g., on starch-producing plants, such as potato, rice, wheat, barley, and the like. Nucleic acids of the invention can be used to manipulate metabolic pathways of a plant in order to optimize or alter host's expression of an isomerase, e.g., racemase, e.g., amino acid racemase, alanine racemase, and/or epimerase. The can change isomerase, e.g., racemase, e.g., amino acid racemase, alanine racemase, and/or epimerase activity in a plant. Alternatively, an isomerase, e.g., racemase, e.g., amino acid racemase, alanine racemase, and/or epimerase of the invention can be used in production of a transgenic plant to produce a compound not naturally produced by that plant. This can lower production costs or create a novel product.

In one aspect, the first step in production of a transgenic plant involves making an expression construct for expression in a plant cell. These techniques are well known in the art. They can include selecting and cloning a promoter, a coding sequence for facilitating efficient binding of ribosomes to mRNA and selecting the appropriate gene terminator sequences. One exemplary constitutive promoter is CaMV35S, from the cauliflower mosaic virus, which generally results in a high degree of expression in plants. Other promoters are more specific and respond to cues in the plant's internal or external environment. An exemplary light-inducible promoter is the promoter from the cab gene, encoding the major chlorophyll a/b binding protein.

In one aspect, the nucleic acid is modified to achieve greater expression in a plant cell. For example, a sequence of the invention is likely to have a higher percentage of A-T nucleotide pairs compared to that seen in a plant, some of which prefer G-C nucleotide pairs. Therefore, A-T nucleotides in the coding sequence can be substituted with G-C nucleotides without significantly changing the amino acid sequence to enhance production of the gene product in plant cells.

Selectable marker gene can be added to the gene construct in order to identify plant cells or tissues that have successfully integrated the transgene. This may be necessary because achieving incorporation and expression of genes in plant cells is a rare event, occurring in just a few percent of the targeted tissues or cells. Selectable marker genes encode proteins that provide resistance to agents that are normally toxic to plants, such as antibiotics or herbicides. Only plant cells that have integrated the selectable marker gene will survive when grown on a medium containing the appropriate antibiotic or herbicide. As for other inserted genes, marker genes also require promoter and termination sequences for proper function.

In one aspect, making transgenic plants or seeds comprises incorporating sequences of the invention and, in one aspect (optionally), marker genes into a target expression construct (e.g., a plasmid), along with positioning of the promoter and the terminator sequences. This can involve transferring the modified gene into the plant through a suitable method. For example, a construct may be introduced directly into the genomic DNA of the plant cell using techniques such as electroporation and microinjection of plant cell protoplasts, or the constructs can be introduced directly to plant tissue using ballistic methods, such as DNA particle bombardment. For example, see, e.g., Christou (1997) Plant Mol. Biol. 35:197-203; Pawlowski (1996) Mol. Biotechnol. 6:17-30; Klein (1987) Nature 327:70-73; Takumi (1997) Genes Genet. Syst. 72:63-69, discussing use of particle bombardment to introduce transgenes into wheat; and Adam (1997) supra, for use of particle bombardment to introduce YACs into plant cells. For example, Rinehart (1997) supra, used particle bombardment to generate transgenic cotton plants. Apparatus for accelerating particles is described U.S. Pat. No. 5,015,580; and, the commercially available BioRad (Biolistics) PDS-2000 particle acceleration instrument; see also, John, U.S. Pat. No. 5,608,148; and Ellis, U.S. Pat. No. 5,681,730, describing particle-mediated transformation of gymnosperms.

In one aspect, protoplasts can be immobilized and injected with a nucleic acids, e.g., an expression construct. Although plant regeneration from protoplasts is not easy with cereals, plant regeneration is possible in legumes using somatic embryogenesis from protoplast derived callus. Organized tissues can be transformed with naked DNA using gene gun technique, where DNA is coated on tungsten microprojectiles, shot 1/100th the size of cells, which carry the DNA deep into cells and organelles. Transformed tissue is then induced to regenerate, usually by somatic embryogenesis. This technique has been successful in several cereal species including maize and rice.

Nucleic acids, e.g., expression constructs, can also be introduced in to plant cells using recombinant viruses. Plant cells can be transformed using viral vectors, such as, e.g., tobacco mosaic virus derived vectors (Rouwendal (1997) Plant Mol. Biol. 33:989-999), see Porta (1996) "Use of viral replicons for the expression of genes in plants," Mol. Biotechnol. 5:209-221.

Alternatively, nucleic acids, e.g., an expression construct, can be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. *Agrobacterium tumefaciens*-mediated transformation techniques, including disarming and use of binary vectors, are well described in the scientific literature. See, e.g., Horsch (1984) *Science* 233:496-498; Fraley (1983) *Proc. Natl. Acad. Sci. USA* 80:4803 (1983); *Gene Transfer to Plants*, Potrykus, ed. (Springer-Verlag, Berlin 1995). The DNA in an *A. tumefaciens* cell is contained in the bacterial chromosome as well as in another structure known as a Ti (tumor-inducing) plasmid. The Ti plasmid contains a stretch of DNA termed T-DNA (~20 kb long) that is transferred to the plant cell in the infection process and a series of vir (virulence) genes that direct the infection process. *A. tumefaciens* can only infect a plant through wounds: when a plant root or stem is wounded it gives off certain chemical signals, in response to which, the vir genes of *A. tumefaciens* become activated and direct a series of events necessary for the transfer of the T-DNA from the Ti plasmid to the plant's chromosome. The T-DNA then enters the plant cell through the wound. One speculation is that the T-DNA waits until the plant DNA is being replicated or transcribed, then inserts itself into the exposed plant DNA. In order to use *A. tumefaciens* as a transgene vector, the tumor-inducing section of T-DNA have to be removed, while retaining the T-DNA border regions and the vir genes. The transgene is then inserted between the T-DNA border regions, where it is transferred to the plant cell and becomes integrated into the plant's chromosomes.

The invention provides for the transformation of monocotyledonous plants using the nucleic acids of the invention, including important cereals, see Hiei (1997) Plant Mol. Biol. 35:205-218. See also, e.g., Horsch, Science (1984) 233:496; Fraley (1983) Proc. Natl. Acad. Sci. USA 80:4803; Thykjaer (1997) supra; Park (1996) Plant Mol. Biol. 32:1135-1148, discussing T-DNA integration into genomic DNA. See also D'Halluin, U.S. Pat. No. 5,712,135, describing a process for the stable integration of a DNA comprising a gene that is functional in a cell of a cereal, or other monocotyledonous plant.

In one aspect, the third step can involve selection and regeneration of whole plants capable of transmitting the incorporated target gene to the next generation. Such regeneration techniques rely on manipulation of certain phytohormones in a tissue culture growth medium, typically relying on a biocide and/or herbicide marker that has been introduced together with the desired nucleotide sequences. Plant regeneration from cultured protoplasts is described in Evans et al., *Protoplasts Isolation and Culture, Handbook of Plant Cell Culture*, pp. 124-176, MacMillilan Publishing Company, New York, 1983; and Binding, *Regeneration of Plants, Plant Protoplasts*, pp. 21-73, CRC Press, Boca Raton, 1985. Regeneration can also be obtained from plant callus, explants, organs, or parts thereof. Such regeneration techniques are described generally in Klee (1987) Ann. Rev. of Plant Phys. 38:467-486. To obtain whole plants from transgenic tissues such as immature embryos, they can be grown under controlled environmental conditions in a series of media containing nutrients and hormones, a process known as tissue culture. Once whole plants are generated and produce seed, evaluation of the progeny begins.

After the expression cassette is stably incorporated in transgenic plants, it can be introduced into other plants by sexual crossing. Any of a number of standard breeding techniques can be used, depending upon the species to be crossed. Since transgenic expression of the nucleic acids of the invention leads to phenotypic changes, plants comprising the recombinant nucleic acids of the invention can be sexually crossed with a second plant to obtain a final product. Thus, the seed of the invention can be derived from a cross between two transgenic plants of the invention, or a cross between a plant of the invention and another plant. The desired effects (e.g., expression of the polypeptides of the invention to produce a plant in which flowering behavior is altered) can be enhanced when both parental plants express the polypeptides (e.g., an isomerase, e.g., racemase, e.g., amino acid racemase, alanine racemase, and/or epimerase) of the invention. The desired effects can be passed to future plant generations by standard propagation means.

The nucleic acids and polypeptides of the invention are expressed in or inserted in any plant or seed. Transgenic plants of the invention can be dicotyledonous or monocotyledonous. Examples of monocot transgenic plants of the invention are grasses, such as meadow grass (blue grass, *Poa*), forage grass such as *festuca, lolium*, temperate grass, such as *Agrostis*, and cereals, e.g., wheat, oats, rye, barley, rice, sorghum, and maize (corn). Examples of dicot transgenic plants of the invention are tobacco, legumes, such as lupins, potato, sugar beet, pea, bean and soybean, and cruciferous plants (family Brassicaceae), such as cauliflower, rape seed, and the closely related model organism *Arabidopsis thaliana*. Thus, the transgenic plants and seeds of the invention include a broad range of plants, including, but not limited to, species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna*, and *Zea*. Transgenic plants and seeds of the invention can be any monocot or dicot, e.g., a monocot corn, sugarcane, rice, wheat, barley, switchgrass or *Miscanthus*; or a dicot oilseed crop, soy, canola, rapeseed, flax, cotton, palm oil, sugar beet, peanut, tree, poplar or lupine.

In alternative embodiments, the nucleic acids of the invention are expressed in plants (and/or their seeds) which contain fiber cells, including, e.g., cotton, silk cotton tree (Kapok, Ceiba pentandra), desert willow, creosote bush, winterfat, balsa, ramie, kenaf, hemp, roselle, jute, sisal abaca and flax. In alternative embodiments, the transgenic plants of the invention can be members of the genus *Gossypium*, including members of any *Gossypium* species, such as *G. arboreum; G. herbaceum, G. barbadense*, and *G. hirsutum*.

The invention also provides for transgenic plants (and/or their seeds) to be used for producing large amounts of the polypeptides (e.g., an isomerase, e.g., racemase, e.g., amino acid racemase, alanine racemase, and/or epimerase or antibody) of the invention. For example, see Palmgren (1997) Trends Genet. 13:348; Chong (1997) Transgenic Res. 6:289-296 (producing human milk protein beta-casein in transgenic potato plants using an auxin-inducible, bidirectional mannopine synthase (mas1',2') promoter with *Agrobacterium tumefaciens*-mediated leaf disc transformation methods).

Using known procedures, one of skill can screen for plants (and/or their seeds) of the invention by detecting the increase or decrease of transgene mRNA or protein in transgenic plants. Means for detecting and quantitation of mRNAs or proteins are well known in the art.

Polypeptides and Peptides

In one aspect, the invention provides isolated, synthetic or recombinant polypeptides and peptides having isomerase activity, e.g., racemase activity, e.g., amino acid racemase activity (e.g., resolving a D- and/or an L-amino acid from a racemic mixture), alanine racemase activity, and/or epimerase activity, or polypeptides and peptides capable of generating an antibody that specifically binds to an isomerase, e.g., a racemase, e.g., an amino acid racemase, an alanine racemase, and/or an epimerase, including an enzyme of this invention, including the amino acid sequences of the invention, which include those having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more, or 100% (complete) sequence identity to an exemplary polypeptide of the invention (as defined above, including SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496 or SEQ ID NO:498), including the sequences described herein and in Tables 1, 2 and 3, and the Sequence Listing (all of these sequences are "exemplary enzymes/polypeptides of the invention"), and enzymatically active subsequences (fragments) thereof.

In one aspect, the invention provides chimeric enzymes, including an isomerase, e.g., a racemase, e.g., an amino acid racemase, an alanine racemase, and/or an epimerase, having heterologous domains, e.g., a binding domain or a dockerin domain, e.g., for use in the processes of the invention and in various industrial, medical, pharmaceutical, research, food and feed and food and feed supplement processing and other applications. For example, in one aspect the invention provides enzymes, e.g., isomerases, e.g., racemases, e.g., amino acid racemases, alanine racemases, and/or epimerases comprising one or more domain of an enzyme of the invention. In another aspect, domains between different enzymes of the invention can be swapped; or, alternatively, one or more domains of one or more enzymes of the invention can be spliced into an enzyme, e.g., an isomerase, e.g., racemase, e.g., amino acid racemase, alanine racemase, and/or epimerase. In one aspect of the invention, the domains are selected from a binding domain or a dockerin domain.

The invention further provides chimeric enzymes having heterologous, non-natural substrates; including chimeric enzymes having multiple substrates by nature of their "spliced-in" heterologous domains—thus giving the chimeric enzyme new specificity or enhanced binding. The heterologous domains of the chimeric enzymes of the invention can be designed to be modular, i.e., to be appended to a catalytic module or catalytic domain (e.g., an active site), which also can be heterologous or can be homologous to the enzyme.

Utilization of just the catalytic module of an isomerase, e.g., a racemase, e.g., an amino acid racemase, an alanine racemase, and/or an epimerase (e.g., an enzyme of the invention) has been shown to be effective. Thus, the invention provides peptides and polypeptides consisting of, or comprising, modular domains/active site modules, which can be homologously paired or joined as chimeric (heterologous) active site module pairs. Thus, these chimeric polypeptides/peptides of the invention can be used to improve or alter the performance of an individual enzyme, e.g., an isomerase, e.g., a racemase, e.g., an amino acid racemase, an alanine racemase, and/or an epimerase enzyme. A chimeric catalytic module of the invention (comprising, e.g., at least one domain of the invention) can be designed to target the enzyme to particular regions of a substrate. For example, in one aspect, this is achieved by making fusions of the isomerase, e.g., racemase, e.g., amino acid racemase, alanine racemase, and/or epimerase and various domains (either an isomerase, e.g., racemase, e.g., amino acid racemase, alanine racemase, and/or epimerase of the invention with a heterologous domain, or, a domain of the invention with another enzyme, e.g., an isomerase, e.g., racemase, e.g., amino acid racemase, alanine racemase, and/or epimerase.

Thus, the invention provides chimeric isomerases, e.g., racemases, e.g., amino acid racemases, alanine racemases, and/or epimerases, e.g., a fusion of an isomerase, e.g., a racemase, e.g., an amino acid racemase, an alanine racemase, and/or an epimerase with different (e.g., heterologous) domains. In one aspect, the chimeric isomerases, e.g., racemases, e.g., amino acid racemases, alanine racemases, and/or epimerases comprise an enzyme of the invention. In one aspect, the chimeric enzyme comprises fusions of different domains. The invention also provides methods comprising recombining different domains with different isomerases, e.g., racemases, e.g., amino acid racemases, alanine racemases, and/or epimerases (e.g., domains of the invention and/or isomerases, e.g., racemases, e.g., amino acid racemases, alanine racemases, and/or epimerases of the invention) and screening the resultant chimerics to find the best combination for a particular application or substrate.

Other variations also are within the scope of this invention, e.g., where one, two, three, four or five or more residues are removed from the carboxy- or amino-terminal ends of any polypeptide of the invention. Another variation includes modifying any residue to increase or decrease pI of a polypeptide, e.g., removing or modifying (e.g., to another amino acid) a glutamate. This method was used as a general scheme for improving the enzyme's properties without creating regulatory issues since no amino acids are mutated; and this general scheme can be used with any polypeptide of the invention.

The invention provides isolated, synthetic or recombinant polypeptides having isomerase, e.g., racemase, e.g., amino acid racemase, alanine racemase, and/or epimerase activity, wherein the polypeptide has a sequence modification of any polypeptide of the invention, including any exemplary amino acid sequence of the invention, including SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496 or SEQ ID NO:498, including the sequences described herein and in Tables 1, 2 and 3, and the Sequence Listing (all of these sequences are "exemplary enzymes/polypeptides of the invention"), and enzymatically active subsequences (fragments) thereof. The sequence change(s) can also comprise any amino acid modification to change the pI of a polypeptide, e.g., deletion or modification of a glutamate, or changing from a glutamate to another residue.

The invention further provides isolated, synthetic or recombinant polypeptides having a sequence identity (e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity) to an exemplary sequence of the invention.

In one aspect, the polypeptide of the invention has an isomerase activity, e.g., racemase activity, e.g., amino acid racemase activity, alanine racemase activity, and/or epimerase activity, and/or catalyze the re-arrangement of atoms within a molecule, catalyze the conversion of one isomer into another, catalyze the conversion of an optically active substrate into a raceme, which is optically inactive, catalyze the interconversion of substrate enantiomers, catalyze the stereochemical inversion around the asymmetric carbon atom in a substrate having only one center of asymmetry, catalyze the stereochemical inversion of the configuration around an asymmetric carbon atom in a substrate having more than one asymmetric center, and/or catalyze the racemization of amino acids.

In one aspect, a polypeptide of the invention has a 5-substituted hydantoin racemase activity, e.g., it can catalyze racemization reaction of an optically active 5-substituted hydantoin compound, such as a D- or L-5-substituted hydantoin compound.

In one aspect, a polypeptide of the invention has peptidyl-prolyl isomerase activity, and can be part of a signaling pathway that leads to T-cell activation, and/or correct protein folding and/or protein trafficking, and also can be involved in assembly/disassembly of protein complexes and regulation of protein activity.

In one aspect, a polypeptide of the invention has a racemase, or isomerase, activity that catalyzes inversion of a molecule's configuration around an asymmetric carbon atom in a substrate having a single center of asymmetry, thereby interconverting two racemers.

In one aspect, a polypeptide of the invention has a racemase, or an epimerase activity, that catalyzes inversion of configuration around an asymmetric carbon atom in a substrate with more than one center of symmetry, thereby interconverting two epimers. Racemases and epimerases of this invention can act on amino acids and their derivatives, hydroxy acids and their derivatives, and carbohydrates and their derivatives. For example, the interconversion of UDP-galactose and UDP-glucose can be catalyzed by an enzyme of this invention having a UDP-galactose-4'-epimerase activity; proper regulation and function of this epimerase is essential to the synthesis of glycoproteins and glycolipids. Elevated blood galactose levels have been correlated with UDP-galactose-4'-epimerase deficiency in screening programs of infants.

In one aspect, a polypeptide of the invention has a serine racemase enzyme activity, and this enzyme can be used to increase or decrease D-serine formation, which can be used as a pharmaceutical (drug) in an individual, e.g., to increase or decrease NMDA receptor activation; a decrease in D-serine formation (by using a serine racemase enzyme of this invention) can aid in the prevention of neuron damage following an ischemic event, such as stroke; and regulation of D-serine formation by a serine racemase enzyme of this invention also can be effective for treating a neurodegenerative condition caused by the over- or under-activation of the glutamate NMDA receptor.

Polypeptides of the invention having a serine racemase enzyme activity can be used to regulate D-serine levels, e.g., to prevent or minimize neuron damage caused, for example, by primary and/or secondary disorders after brain injury, motor unit-like neurogenic and myopathic disorders, neurodegenerative disorders like Alzheimer's and Parkinson's disease, disorders leading to peripheral and chronic pain. See, e.g., U.S. Pat. App. Pub. No. 20030175941.

Any isomerase activity, e.g., racemase activity, e.g., amino acid racemase activity, alanine racemase activity, and/or epimerase activity assay known in the art can be used to determine if a polypeptide has isomerase activity, e.g., racemase activity, e.g., amino acid racemase activity, alanine racemase activity, and/or epimerase activity and is within scope of the invention. For example, Schonfeld and Bornscheuer (Anal Chem. 2004 Feb. 15; 76(4):1184-8) describe a polarimetric assay which identifies alpha-amino acid racemase activity using a glutamate racemase from *Lactobacillus fermentii*, expressed in *E. coli*, and measuring the time-dependent change of the optical rotation using the 1-glutamate as the substrate.

Another exemplary method for detecting racemase activity to determine if a polypeptide is within the scope of this invention is described in U.S. Pat. App. Pub. No. 20070128601, and comprises providing a reaction medium containing a D-amino acid specific to the racemase to be detected; reacting the D-amino acid with a D-amino oxidase with a prosthetic group to form a reduced prosthetic group by oxidation of the D-amino acid; reacting the reduced prosthetic group with oxygen to form hydrogen peroxide; and detecting the hydrogen peroxide thus formed; wherein the detection of hydrogen peroxide indicates racemase activity in the reaction medium. An exemplary method for detecting a D-amino acid in a sample comprises oxidatively deaminating a D-amino acid by reaction with a D-amino acid oxidase in a prosthetic group; and, detecting the hydrogen peroxide generated by the oxidative deamination; wherein the presence of hydrogen peroxide is indicative of the presence of a D-amino acid in the sample.

Another exemplary method for detecting racemase activity to determine if a polypeptide is within the scope of this invention is described in U.S. Pat. App. Pub. No. 20060014162, and comprises detecting a D-amino acid by providing a reaction medium containing a D-amino acid; reacting the D-amino acid with a D-amino oxidase with a prosthetic group to form a reduced prosthetic group by oxidative deamination of the D-amino acid with a primary amine or oxidation of the D-amino acid with a secondary amine; reacting the reduced prosthetic group with oxygen to form hydrogen peroxide; and detecting the hydrogen peroxide thus formed.

The polypeptides of the invention include isomerases, e.g., racemases, e.g., amino acid racemases, alanine racemases, and/or epimerases in an active or inactive form. For example, the polypeptides of the invention include proproteins before "maturation" or processing of prepro sequences, e.g., by a proprotein-processing enzyme, such as a proprotein convertase to generate an "active" mature protein. The polypeptides of the invention include isomerases, e.g., racemases, e.g., amino acid racemases, alanine racemases, and/or epimerases inactive for other reasons, e.g., before "activation" by a post-translational processing event, e.g., an endo- or exo-peptidase or proteinase action, a phosphorylation event, an amidation, a glycosylation or a sulfation, a dimerization event, and the like. The polypeptides of the invention include all active forms, including active subsequences, e.g., catalytic domains or active sites, of the isomerase, e.g., racemase, e.g., amino acid racemase, alanine racemase, and/or epimerase.

Methods for identifying "prepro" domain sequences and signal sequences are well known in the art, see, e.g., Van de Ven (1993) Crit. Rev. Oncog. 4(2):115-136. For example, to identify a prepro sequence, the protein is purified from the extracellular space and the N-terminal protein sequence is determined and compared to the unprocessed form.

The invention includes polypeptides with or without a signal sequence and/or a prepro sequence. The invention includes polypeptides with heterologous signal sequences and/or prepro sequences. The prepro sequence (including a sequence of the invention used as a heterologous prepro domain) can be located on the amino terminal or the carboxy terminal end of the protein. The invention also includes isolated, synthetic or recombinant signal sequences, prepro sequences and catalytic domains (e.g., "active sites") comprising sequences of the invention.

The percent sequence identity can be over the full length of the polypeptide, or, the identity can be over a region of at least about 50, 60, 70, 80, 90, 100, 150, 200, 250, 300, 350, 400, 450, 500, 550, 600, 650, 700 or more residues. Polypeptides of the invention can also be shorter than the full length of exemplary polypeptides. In alternative aspects, the invention provides polypeptides (peptides, fragments) ranging in size between about 5 and the full length of a polypeptide, e.g., an enzyme, such as an isomerase, e.g., racemase, e.g., amino acid racemase, alanine racemase, and/or epimerase; exemplary sizes being of about 5, 10, 15, 20, 25, 30, 35, 40, 45, 50, 55, 60, 65, 70, 75, 80, 85, 90, 100, 125, 150, 175, 200, 250, 300, 350, 400, 450, 500, 550, 600, 650, 700, or more residues, e.g., contiguous residues of an exemplary isomerase, e.g., racemase, e.g., amino acid racemase, alanine racemase, and/or epimerase of the invention.

Peptides of the invention (e.g., a subsequence of an exemplary polypeptide of the invention) can be useful as, e.g., labeling probes, antigens, toleragens, motifs, active sites (e.g., "catalytic domains"), signal sequences and/or prepro domains.

Polypeptides and peptides of the invention can be isolated from natural sources, be synthetic, or be recombinantly generated polypeptides. Peptides and proteins can be recombinantly expressed in vitro or in vivo. The peptides and polypeptides of the invention can be made and isolated using any method known in the art. Polypeptides and peptides of the invention can also be synthesized, whole or in part, using chemical methods well known in the art. See e.g., Caruthers (1980) Nucleic Acids Res. Symp. Ser. 215-223; Horn (1980) Nucleic Acids Res. Symp. Ser. 225-232; Banga, A. K., Therapeutic Peptides and Proteins, Formulation, Processing and Delivery Systems (1995) Technomic Publishing Co., Lancaster, Pa. For example, peptide synthesis can be performed using various solid-phase techniques (see e.g., Roberge (1995) Science 269:202; Merrifield (1997) Methods Enzymol. 289:3-13) and automated synthesis may be achieved, e.g., using the ABI 431A Peptide Synthesizer (Perkin Elmer) in accordance with the instructions provided by the manufacturer.

The peptides and polypeptides of the invention can also be glycosylated. The glycosylation can be added post-translationally either chemically or by cellular biosynthetic mechanisms, wherein the later incorporates the use of known glycosylation motifs, which can be native to the sequence or can be added as a peptide or added in the nucleic acid coding sequence. The glycosylation can be O-linked or N-linked.

"Amino acid" or "amino acid sequence" as used herein refer to an oligopeptide, peptide, polypeptide, or protein sequence, or to a fragment, portion, or subunit of any of these and to naturally occurring or synthetic molecules. "Amino acid" or "amino acid sequence" include an oligopeptide, peptide, polypeptide, or protein sequence, or to a fragment, portion, or subunit of any of these, and to naturally occurring or synthetic molecules. The term "polypeptide" as used herein, refers to amino acids joined to each other by peptide bonds or modified peptide bonds, i.e., peptide isosteres and may contain modified amino acids other than the 20 gene-encoded amino acids. The polypeptides may be modified by either natural processes, such as post-translational processing, or by chemical modification techniques that are well known in the art. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristoylation, oxidation, pegylation, phosphorylation, prenylation, racemization, selenoylation, sulfation and transfer-RNA mediated addition of amino acids to protein such as arginylation. (See Creighton, T. E., *Proteins—Structure and Molecular Properties 2nd Ed.*, W.H. Freeman and Company, New York (1993); *Posttranslational Covalent Modification of Proteins*, B.C. Johnson, Ed., Academic Press, New York, pp. 1-12 (1983)). The peptides and polypeptides of the invention also include all "mimetic" and "peptidomimetic" forms, as described in further detail, below.

"Recombinant" polypeptides or proteins refer to polypeptides or proteins produced by recombinant DNA techniques; i.e., produced from cells transformed by an exogenous DNA construct encoding the desired polypeptide or protein. "Synthetic" nucleic acids (including oligonucleotides), polypeptides or proteins of the invention include those prepared by any chemical synthesis, e.g., as described, below. Solid-phase chemical peptide synthesis methods can also be used to synthesize the polypeptide or fragments of the invention. Such method have been known in the art since the early 1960's (Merrifield, R. B., *J. Am. Chem. Soc.*, 85:2149-2154, 1963) (See also Stewart, J. M. and Young, J. D., *Solid Phase Peptide Synthesis, 2nd Ed.*, Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, *Proc. Natl. Acad. Sci., USA*, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431A automated peptide synthesizer. Such equipment provides ready access to the peptides of the invention, either by direct synthesis or by synthesis of a series of fragments that can be coupled using other known techniques.

"Fragments" as used herein are a portion of a naturally occurring protein which can exist in at least two different conformations. Fragments can have the same or substantially the same amino acid sequence as the naturally occurring protein. "Substantially the same" means that an amino acid sequence is largely, but not entirely, the same, but retains at least one functional activity of the sequence to which it is related. In general two amino acid sequences are "substantially the same" or "substantially homologous" if they are at least about 85% identical. Fragments which have different three dimensional structures as the naturally occurring protein are also included. An example of this, is a "pro-form" molecule, such as a low activity proprotein that can be modified by cleavage to produce a mature enzyme with significantly higher activity.

The peptides and polypeptides of the invention, as defined above, include all "mimetic" and "peptidomimetic" forms. The terms "mimetic" and "peptidomimetic" refer to a synthetic chemical compound which has substantially the same structural and/or functional characteristics of the polypeptides of the invention. The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. As with polypeptides of the invention which are conservative variants, routine experimentation will determine whether a mimetic is within the scope of the invention, i.e., that its structure and/or function is not substantially altered. Thus, in one aspect, a mimetic composition is within the scope of the invention if it has an isomerase, e.g., racemase, e.g., amino acid racemase, alanine racemase, and/or epimerase activity.

Polypeptide mimetic compositions of the invention can contain any combination of non-natural structural components. In alternative aspect, mimetic compositions of the invention include one or all of the following three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like. For example, a polypeptide of the invention can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'-diisopropylcarbodiimide (DIC). Linking groups that can be an alternative to the traditional amide bond ("peptide bond") linkages include, e.g., ketomethylene (e.g., —C(=O)—CH$_2$— for —C(=O)—NH—), aminomethylene (CH$_2$—NH), ethylene, olefin (CH=CH), ether (CH$_2$—O), thioether (CH$_2$—S), tetrazole (CN$_4$—), thiazole, retroamide, thioamide, or ester (see, e.g., Spatola (1983) in Chemistry and Biochemistry of Amino Acids, Peptides and Proteins, Vol. 7, pp 267-357, "Peptide Backbone Modifications," Marcell Dekker, New York).

A polypeptide of the invention can also be characterized as a mimetic by containing all or some non-natural residues in place of naturally occurring amino acid residues. Non-natural residues are well described in the scientific and patent literature; a few exemplary non-natural compositions useful as mimetics of natural amino acid residues and guidelines are described below. Mimetics of aromatic amino acids can be generated by replacing by, e.g., D- or L-naphylalanine; D- or L-phenylglycine; D- or L-2 thieneylalanine; D- or L-1, -2,3-, or 4-pyreneylalanine; D- or L-3 thieneylalanine; D- or L-(2-pyridinyl)-alanine; D- or L-(3-pyridinyl)-alanine; D- or L-(2-pyrazinyl)-alanine; D- or L-(4-isopropyl)-phenylglycine; D-(trifluoromethyl)-phenylglycine; D-(trifluoromethyl)-phenylalanine; D-p-fluoro-phenylalanine; D- or L-p-biphenylphenylalanine; D- or L-p-methoxy-biphenylphenylalanine; D- or L-2-indole(alkyl)alanines; and, D- or L-alkylainines, where alkyl can be substituted or unsubstituted methyl, ethyl, propyl, hexyl, butyl, pentyl, isopropyl, iso-butyl, sec-isotyl, iso-pentyl, or a non-acidic amino acids. Aromatic rings of a non-natural amino acid include, e.g., thiazolyl, thiophenyl, pyrazolyl, benzimidazolyl, naphthyl, furanyl, pyrrolyl, and pyridyl aromatic rings.

Mimetics of acidic amino acids can be generated by substitution by, e.g., non-carboxylate amino acids while maintaining a negative charge; (phosphono)alanine; sulfated threonine. Carboxyl side groups (e.g., aspartyl or glutamyl) can also be selectively modified by reaction with carbodiimides (R'—N—C—N—R') such as, e.g., 1-cyclohexyl-3(2-morpholinyl-(4-ethyl) carbodiimide or 1-ethyl-3(4-azonia-4,4-dimetholpentyl) carbodiimide. Aspartyl or glutamyl can also be converted to asparaginyl and glutaminyl residues by reaction with ammonium ions. Mimetics of basic amino acids can be generated by substitution with, e.g., (in addition to lysine and arginine) the amino acids ornithine, citrulline, or (guanidino)-acetic acid, or (guanidino)alkyl-acetic acid, where alkyl is defined above. Nitrile derivative (e.g., containing the CN-moiety in place of COOH) can be substituted for asparagine or glutamine. Asparaginyl and glutaminyl residues can be deaminated to the corresponding aspartyl or glutamyl residues. Arginine residue mimetics can be generated by reacting arginyl with, e.g., one or more conventional reagents, including, e.g., phenylglyoxal, 2,3-butanedione, 1,2-cyclo-hexanedione, or ninhydrin, preferably under alkaline conditions. Tyrosine residue mimetics can be generated by reacting tyrosyl with, e.g., aromatic diazonium compounds or tetranitromethane. N-acetylimidizol and tetranitromethane can be used to form O-acetyl tyrosyl species and 3-nitro derivatives, respectively. Cysteine residue mimetics can be generated by reacting cysteinyl residues with, e.g., alpha-haloacetates such as 2-chloroacetic acid or chloroacetamide and corresponding amines; to give carboxymethyl or carboxyamidomethyl derivatives. Cysteine residue mimetics can also be generated by reacting cysteinyl residues with, e.g., bromo-trifluoroacetone, alpha-bromo-beta-(5-imidozoyl) propionic acid; chloroacetyl phosphate, N-alkylmaleimides, 3-nitro-2-pyridyl disulfide; methyl 2-pyridyl disulfide; p-chloromercuribenzoate; 2-chloromercuri-4 nitrophenol; or, chloro-7-nitrobenzo-oxa-1,3-diazole. Lysine mimetics can be generated (and amino terminal residues can be altered) by reacting lysinyl with, e.g., succinic or other carboxylic acid anhydrides. Lysine and other alpha-amino-containing residue mimetics can also be generated by reaction with imidoesters, such as methyl picolinimidate, pyridoxal phosphate, pyridoxal, chloroborohydride, trinitro-benzene-sulfonic acid, O-methylisourea, 2,4, pentanedione, and transamidase-catalyzed reactions with glyoxylate. Mimetics of methionine can be generated by reaction with, e.g., methionine sulfoxide. Mimetics of proline include, e.g., pipecolic acid, thiazolidine carboxylic acid, 3- or 4-hydroxy proline, dehydroproline, 3- or 4-methylproline, or 3,3,-dimethylproline. Histidine residue mimetics can be generated by reacting histidyl with, e.g., diethylprocarbonate or para-bromophenacyl bromide. Other mimetics include, e.g., those generated by hydroxylation of proline and lysine; phosphorylation of the hydroxyl groups of seryl or threonyl residues; methylation of the alpha-amino groups of lysine, arginine and histidine; acetylation of the N-terminal amine; methylation of main chain amide residues or substitution with N-methyl amino acids; or amidation of C-terminal carboxyl groups.

A residue, e.g., an amino acid, of a polypeptide of the invention can also be replaced by an amino acid (or peptidomimetic residue) of the opposite chirality. Thus, any amino acid naturally occurring in the L-configuration (which can also be referred to as the R or S, depending upon the structure of the chemical entity) can be replaced with the amino acid of the same chemical structural type or a peptidomimetic, but of the opposite chirality, referred to as the D-amino acid, but also can be referred to as the R- or S-form.

The invention also provides methods for modifying the polypeptides of the invention by either natural processes, such as post-translational processing (e.g., phosphorylation, acylation, etc), or by chemical modification techniques, and the resulting modified polypeptides. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, proteolytic processing, phosphorylation, prenylation, racemization, selenoylation, sulfation, and transfer-RNA mediated addition of amino acids to protein such as arginylation. See, e.g., Creighton, T. E., Proteins—Structure and Molecular Properties 2nd Ed., W.H. Freeman and Company, New York (1993); Posttranslational Covalent Modification of Proteins, B. C. Johnson, Ed., Academic Press, New York, pp. 1-12 (1983).

Solid-phase chemical peptide synthesis methods can also be used to synthesize the polypeptide or fragments of the invention. Such method have been known in the art since the early 1960's (Merrifield, R. B., J. Am. Chem. Soc., 85:2149-2154, 1963) (See also Stewart, J. M. and Young, J. D., Solid Phase Peptide Synthesis, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, Proc. Natl. Acad. Sci., USA, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431A™ automated peptide synthesizer. Such equipment provides ready access to the peptides of the invention, either by direct synthesis or by synthesis of a series of fragments that can be coupled using other known techniques.

The invention includes isomerases, e.g., racemases, e.g., amino acid racemases, alanine racemases, and/or epimerases of the invention with and without signal. The polypeptide comprising a signal sequence of the invention can be an isomerase, e.g., racemase, e.g., amino acid racemase, alanine racemase, and/or epimerase of the invention or another isomerase, e.g., racemase, e.g., amino acid racemase, alanine racemase, and/or epimerase or another enzyme or other polypeptide.

The invention includes immobilized isomerases, e.g., racemases, e.g., amino acid racemases, alanine racemases, and/or epimerases and anti-isomerase, e.g., anti-racemase, e.g., anti-amino acid racemase, anti-alanine racemase, and/or anti-epimerase antibodies and fragments thereof. The invention provides methods for inhibiting isomerase, e.g., racemase, e.g., amino acid racemase, alanine racemase, and/or epimerase activity, e.g., using dominant negative mutants or anti-isomerase, e.g., anti-racemase, e.g., anti-amino acid racemase, anti-alanine racemase, and/or anti-epimerase antibodies of the invention. The invention includes heterocomplexes, e.g., fusion proteins, heterodimers, etc., comprising the isomerases, e.g., racemases, e.g., amino acid racemases, alanine racemases, and/or epimerases of the invention.

Polypeptides of the invention can have an isomerase, e.g., racemase, e.g., amino acid racemase, alanine racemase, and/or epimerase activity under various conditions, e.g., extremes in pH and/or temperature, oxidizing agents, and the like. The invention provides methods leading to alternative isomerase, e.g., racemase, e.g., amino acid racemase, alanine racemase, and/or epimerase preparations with different catalytic efficiencies and stabilities, e.g., towards temperature, oxidizing agents and changing wash conditions. In one aspect, isomerase, e.g., racemase, e.g., amino acid racemase, alanine racemase, and/or epimerase variants can be produced using techniques of site-directed mutagenesis and/or random mutagenesis. In one aspect, directed evolution can be used to produce a great variety of isomerase, e.g., racemase, e.g., amino acid racemase, alanine racemase, and/or epimerase variants with alternative specificities and stability.

The proteins of the invention are also useful as research reagents to identify isomerase, e.g., racemase, e.g., amino acid racemase, alanine racemase, and/or epimerase modulators, e.g., activators or inhibitors of isomerase, e.g., racemase, e.g., amino acid racemase, alanine racemase, and/or epimerase activity. Briefly, test samples (compounds, broths, extracts, and the like) are added to isomerase, e.g., racemase, e.g., amino acid racemase, alanine racemase, and/or epimerase assays to determine their ability to inhibit substrate cleavage. Inhibitors identified in this way can be used in industry and research to reduce or prevent undesired proteolysis. Inhibitors can be combined to increase the spectrum of activity.

The enzymes of the invention are also useful as research reagents to digest proteins or in protein sequencing. For example, the isomerases, e.g., racemases, e.g., amino acid racemases, alanine racemases, and/or epimerases may be used to break polypeptides into smaller fragments for sequencing using, e.g. an automated sequencer.

The invention also provides methods of discovering new isomerases, e.g., racemases, e.g., amino acid racemases, alanine racemases, and/or epimerases using the nucleic acids, polypeptides and antibodies of the invention. In one aspect, phagemid libraries are screened for expression-based discovery of isomerases, e.g., racemases, e.g., amino acid racemases, alanine racemases, and/or epimerases. In another aspect, lambda phage libraries are screened for expression-based discovery of isomerases, e.g., racemases, e.g., amino acid racemases, alanine racemases, and/or epimerases. Screening of the phage or phagemid libraries can allow the detection of toxic clones; improved access to substrate; reduced need for engineering a host, by-passing the potential for any bias resulting from mass excision of the library; and, faster growth at low clone densities. Screening of phage or phagemid libraries can be in liquid phase or in solid phase. In one aspect, the invention provides screening in liquid phase. This gives a greater flexibility in assay conditions; additional substrate flexibility; higher sensitivity for weak clones; and ease of automation over solid phase screening.

The invention provides screening methods using the proteins and nucleic acids of the invention and robotic automation to enable the execution of many thousands of biocatalytic reactions and screening assays in a short period of time, e.g., per day, as well as ensuring a high level of accuracy and reproducibility (see discussion of arrays, below). As a result, a library of derivative compounds can be produced in a matter of weeks. For further teachings on modification of molecules, including small molecules, see PCT/US94/09174.

Another aspect of the invention is an isolated or purified polypeptide comprising the sequence of one of the invention and sequences substantially identical thereto, or fragments comprising at least about 5, 10, 15, 20, 25, 30, 35, 40, 50, 75, 100, or 150 consecutive amino acids thereof. As discussed above, such polypeptides may be obtained by inserting a nucleic acid encoding the polypeptide into a vector such that the coding sequence is operably linked to a sequence capable of driving the expression of the encoded polypeptide in a suitable host cell. For example, the expression vector may comprise a promoter, a ribosome binding site for translation initiation and a transcription terminator. The vector may also include appropriate sequences for amplifying expression.

Another aspect of the invention is polypeptides or fragments thereof which have at least about 50%, at least about 55%, at least about 60%, at least about 65%, at least about 70%, at least about 75%, at least about 80%, at least about 85%, at least about 90%, at least about 95%, or more than about 95% homology to one of the polypeptides of the invention and sequences substantially identical thereto, or a fragment comprising at least 5, 10, 15, 20, 25, 30, 35, 40, 50, 75, 100, or 150 consecutive amino acids thereof. Homology may be determined using any of the programs described above which aligns the polypeptides or fragments being compared and determines the extent of amino acid identity or similarity between them. It will be appreciated that amino acid "homology" includes conservative amino acid substitutions such as those described above.

The polypeptides or fragments having homology to one of the polypeptides of the invention, or a fragment comprising at least about 5, 10, 15, 20, 25, 30, 35, 40, 50, 75, 100, or 150 consecutive amino acids thereof may be obtained by isolating the nucleic acids encoding them using the techniques described above.

Alternatively, the homologous polypeptides or fragments may be obtained through biochemical enrichment or purification procedures. The sequence of potentially homologous polypeptides or fragments may be determined by gel electrophoresis and/or microsequencing. The sequence of the prospective homologous polypeptide or fragment can be compared to one of the polypeptides of the invention, or a fragment comprising at least about 5, 10, 15, 20, 25, 30, 35, 40, 50, 75, 100, or 150 consecutive amino acids thereof using any of the programs described above.

Another aspect of the invention is an assay for identifying fragments or variants of The invention, which retain the enzymatic function of the polypeptides of the invention. For example the fragments or variants of said polypeptides, may be used to catalyze biochemical reactions, which indicate that the fragment or variant retains the enzymatic activity of the polypeptides of the invention.

The assay for determining if fragments of variants retain the enzymatic activity of the polypeptides of the invention includes the steps of: contacting the polypeptide fragment or variant with a substrate molecule under conditions which allow the polypeptide fragment or variant to function and detecting either a decrease in the level of substrate or an increase in the level of the specific reaction product of the reaction between the polypeptide and substrate.

The present invention exploits the unique catalytic properties of enzymes. Whereas the use of biocatalysts (i.e., purified or crude enzymes, non-living or living cells) in chemical transformations normally requires the identification of a particular biocatalyst that reacts with a specific starting compound, the present invention uses selected biocatalysts and reaction conditions that are specific for functional groups that are present in many starting compounds, such as small molecules. Each biocatalyst is specific for one functional group, or several related functional groups and can react with many starting compounds containing this functional group.

The biocatalytic reactions produce a population of derivatives from a single starting compound. These derivatives can be subjected to another round of biocatalytic reactions to produce a second population of derivative compounds. Thousands of variations of the original small molecule or compound can be produced with each iteration of biocatalytic derivatization.

Enzymes react at specific sites of a starting compound without affecting the rest of the molecule, a process which is very difficult to achieve using traditional chemical methods. This high degree of biocatalytic specificity provides the means to identify a single active compound within the library. The library is characterized by the series of biocatalytic reactions used to produce it, a so called "biosynthetic history". Screening the library for biological activities and tracing the biosynthetic history identifies the specific reaction sequence producing the active compound. The reaction sequence is repeated and the structure of the synthesized compound determined. This mode of identification, unlike other synthesis and screening approaches, does not require immobilization technologies and compounds can be synthesized and tested free in solution using virtually any type of screening assay. It is important to note, that the high degree of specificity of enzyme reactions on functional groups allows for the "tracking" of specific enzymatic reactions that make up the biocatalytically produced library.

Many of the procedural steps are performed using robotic automation enabling the execution of many thousands of biocatalytic reactions and screening assays per day as well as ensuring a high level of accuracy and reproducibility. As a result, a library of derivative compounds can be produced in a matter of weeks which would take years to produce using current chemical methods.

In a particular aspect, the invention provides a method for modifying small molecules, comprising contacting a polypeptide encoded by a polynucleotide described herein or enzymatically active fragments thereof with a small molecule to produce a modified small molecule. A library of modified small molecules is tested to determine if a modified small molecule is present within the library which exhibits a desired activity. A specific biocatalytic reaction which produces the modified small molecule of desired activity is identified by systematically eliminating each of the biocatalytic reactions used to produce a portion of the library and then testing the small molecules produced in the portion of the library for the presence or absence of the modified small molecule with the desired activity. The specific biocatalytic reactions which produce the modified small molecule of desired activity is in one aspect (optionally) repeated. The biocatalytic reactions are conducted with a group of biocatalysts that react with distinct structural moieties found within the structure of a small molecule, each biocatalyst is specific for one structural moiety or a group of related structural moieties; and each biocatalyst reacts with many different small molecules which contain the distinct structural moiety.

Isomerase Signal Sequences, Prepro and Catalytic Domains

The invention provides isomerase, e.g., racemase, e.g., amino acid racemase, alanine racemase, and/or epimerase signal sequences (e.g., signal peptides (SPs)), prepro domains and catalytic domains (CDs). The SPs, prepro domains and/or CDs of the invention can be isolated, synthetic or recombinant peptides or can be part of a fusion protein, e.g., as a heterologous domain in a chimeric protein. The invention provides nucleic acids encoding these catalytic domains (CDs), prepro domains and signal sequences (SPs, e.g., a peptide having a sequence comprising/consisting of amino terminal residues of a polypeptide of the invention). In one aspect, the invention provides a signal sequence comprising a peptide comprising/consisting of a sequence as set forth in residues 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 39, 1 to 40, 1 to 41, 1 to 42, 1 to 43, 1 to 44, 1 to 45, 1 to 46, 1 to 47, 1 to 48, 1 to 49 or 1 to 50, of a polypeptide of the invention.

The isomerase, e.g., racemase, e.g., amino acid racemase, alanine racemase, and/or epimerase signal sequences (SPs) and/or prepro sequences of the invention can be isolated peptides, or, sequences joined to another isomerase, e.g., racemase, e.g., amino acid racemase, alanine racemase, and/or epimerase or a non-isomerase, e.g., non-racemase, e.g., non-amino acid racemase, non-alanine racemase, and/or non-epimerase polypeptide, e.g., as a fusion (chimeric) protein. In one aspect, the invention provides polypeptides comprising isomerase, e.g., racemase, e.g., amino acid racemase, alanine racemase, and/or epimerase signal sequences of the invention. In one aspect, polypeptides comprising isomerase, e.g., racemase, e.g., amino acid racemase, alanine racemase, and/or epimerase signal sequences SPs and/or prepro of the invention comprise sequences heterologous to an isomerase, e.g., racemase, e.g., amino acid racemase, alanine racemase, and/or epimerase of the invention (e.g., a fusion protein comprising an SP and/or prepro of the invention and sequences from another isomerase, e.g., racemase, e.g., amino acid racemase, alanine racemase, and/or epimerase or a non-isomerase, e.g., non-racemase, e.g., non-amino acid racemase, non-alanine racemase, and/or non-epimerase polypeptide protein). In one aspect, the invention provides isomerase, e.g., racemase, e.g., amino acid racemase, alanine racemase, and/or epimerase of the invention with heterologous SPs and/or prepro sequences, e.g., sequences with a yeast signal sequence. An isomerase, e.g., racemase, e.g., amino acid racemase, alanine racemase, and/or epimerase of the invention can comprise a heterologous SP and/or prepro in a vector, e.g., a pPIC series vector (Invitrogen, Carlsbad, Calif.).

In one aspect, SPs and/or prepro sequences of the invention are identified following identification of novel isomerase, e.g., racemase, e.g., amino acid racemase, alanine racemase, and/or epimerase polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. More than 100 signal sequences for proteins in this group have been determined. The signal sequences can vary in length from between about 10 to 50 amino acid residues. Various methods of recognition of signal sequences are known to those of skill in the art. For example, in one aspect, novel isomerase, e.g., racemase, e.g., amino acid racemase, alanine racemase, and/or epimerase signal peptides are identified by a method referred to as SignalP. SignalP uses a combined neural network which recognizes both signal peptides and their cleavage sites; see, e.g., Nielsen (1997) "Identification of prokaryotic and eukaryotic signal peptides and prediction of their cleavage sites." Protein Engineering 10:1-6.

It should be understood that in some aspects isomerases, e.g., racemases, e.g., amino acid racemases, alanine racemases, and/or epimerases of the invention may not have SPs and/or prepro sequences, or "domains." In one aspect, the invention provides the isomerases, e.g., racemases, e.g., amino acid racemases, alanine racemases, and/or epimerases of the invention lacking all or part of an SP and/or a prepro domain. In one aspect, the invention provides a nucleic acid sequence encoding a signal sequence (SP) and/or prepro from one isomerase, e.g., racemase, e.g., amino acid racemase, alanine racemase, and/or epimerase operably linked to a nucleic acid sequence of a different isomerase, e.g., racemase, e.g., amino acid racemase, alanine racemase, and/or epimerase or, in one aspect (optionally), a signal sequence (SPs) and/or prepro domain from a non-isomerase, e.g., non-racemase, e.g., non-amino acid racemase, non-alanine racemase, and/or non-epimerase protein may be desired.

The invention also provides isolated, synthetic or recombinant polypeptides comprising signal sequences (SPs), prepro domain and/or catalytic domains (CDs) of the invention and heterologous sequences. The heterologous sequences are sequences not naturally associated (e.g., to an isomerase, e.g., racemase, e.g., amino acid racemase, alanine racemase, and/or epimerase) with an SP, prepro domain and/or CD. The sequence to which the SP, prepro domain and/or CD are not naturally associated can be on the SP's, prepro domain and/or CD's amino terminal end, carboxy terminal end, and/or on both ends of the SP and/or CD. In one aspect, the invention provides an isolated, synthetic or recombinant polypeptide comprising (or consisting of) a polypeptide comprising a signal sequence (SP), prepro domain and/or catalytic domain (CD) of the invention with the proviso that it is not associated with any sequence to which it is naturally associated (e.g., an isomerase, e.g., racemase, e.g., amino acid racemase, alanine racemase, and/or epimerase sequence). Similarly in one aspect, the invention provides isolated, synthetic or recombinant nucleic acids encoding these polypeptides. Thus, in one aspect, the isolated, synthetic or recombinant nucleic acid of the invention comprises coding sequence for a signal sequence (SP), prepro domain and/or catalytic domain (CD) of the invention and a heterologous sequence (i.e., a sequence not naturally associated with the a signal sequence (SP), prepro domain and/or catalytic domain (CD) of the invention). The heterologous sequence can be on the 3' terminal end, 5' terminal end, and/or on both ends of the SP, prepro domain and/or CD coding sequence.

Hybrid (Chimeric) Isomerases and Peptide Libraries

In one aspect, the invention provides hybrid isomerases, e.g., racemases, e.g., amino acid racemases, alanine racemases, and/or epimerases and fusion proteins, including peptide libraries, comprising sequences of the invention. The peptide libraries of the invention can be used to isolate peptide modulators (e.g., activators or inhibitors) of targets, such as isomerase, e.g., racemase, e.g., amino acid racemase, alanine racemase, and/or epimerase substrates, receptors, enzymes. The peptide libraries of the invention can be used to identify formal binding partners of targets, such as ligands, e.g., cytokines, hormones and the like. In one aspect, the invention provides chimeric proteins comprising a signal sequence (SP), prepro domain and/or catalytic domain (CD) of the invention or a combination thereof and a heterologous sequence (see above).

In one aspect, the fusion proteins of the invention (e.g., the peptide moiety) are conformationally stabilized (relative to linear peptides) to allow a higher binding affinity for targets. The invention provides fusions of isomerases, e.g., racemases, e.g., amino acid racemases, alanine racemases, and/or epimerases of the invention and other peptides, including known and random peptides. They can be fused in such a manner that the structure of the isomerases, e.g., racemases, e.g., amino acid racemases, alanine racemases, and/or epimerases is not significantly perturbed and the peptide is metabolically or structurally conformationally stabilized. This allows the creation of a peptide library that is easily monitored both for its presence within cells and its quantity.

Amino acid sequence variants of the invention can be characterized by a predetermined nature of the variation, a feature that sets them apart from a naturally occurring form, e.g., an allelic or interspecies variation of an isomerase, e.g., racemase, e.g., amino acid racemase, alanine racemase, and/or epimerase sequence. In one aspect, the variants of the invention exhibit the same qualitative biological activity as the naturally occurring analogue. Alternatively, the variants can be selected for having modified characteristics. In one aspect, while the site or region for introducing an amino acid sequence variation is predetermined, the mutation per se need not be predetermined. For example, in order to optimize the performance of a mutation at a given site, random mutagenesis may be conducted at the target codon or region and the expressed isomerase, e.g., racemase, e.g., amino acid racemase, alanine racemase, and/or epimerase variants screened for the optimal combination of desired activity. Techniques for making substitution mutations at predetermined sites in DNA having a known sequence are well known, as discussed herein for example, M13 primer mutagenesis and PCR mutagenesis. Screening of the mutants can be done using, e.g., assays of isomerase, e.g., racemase, e.g., amino acid racemase, alanine racemase, and/or epimerase activity. In alternative aspects, amino acid substitutions can be single residues; insertions can be on the order of from about 1 to 20 amino acids, although considerably larger insertions can be done. Deletions can range from about 1 to about 20, 30, 40, 50, 60, 70 residues or more. To obtain a final derivative with the optimal properties, substitutions, deletions, insertions or any combination thereof may be used. Generally, these changes are done on a few amino acids to minimize the alteration of the molecule. However, larger changes may be tolerated in certain circumstances.

The invention provides isomerases, e.g., racemases, e.g., amino acid racemases, alanine racemases, and/or epimerases where the structure of the polypeptide backbone, the secondary or the tertiary structure, e.g., an alpha-helical or beta-sheet structure, has been modified. In one aspect, the charge or hydrophobicity has been modified. In one aspect, the bulk of a side chain has been modified. Substantial changes in function or immunological identity are made by selecting substitutions that are less conservative. For example, substitutions can be made which more significantly affect: the structure of the polypeptide backbone in the area of the alteration, for example a alpha-helical or a beta-sheet structure; a charge or a hydrophobic site of the molecule, which can be at an active site; or a side chain. The invention provides substitutions in polypeptide of the invention where (a) a hydrophilic residues, e.g. seryl or threonyl, is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine. The variants can exhibit the same qualitative biological activity (i.e. isomerase, e.g., racemase, e.g., amino acid racemase, alanine racemase, and/or epimerase activity) although variants can be selected to modify the characteristics of the isomerases, e.g., racemases, e.g., amino acid racemases, alanine racemases, and/or epimerases as needed.

In one aspect, isomerases, e.g., racemases, e.g., amino acid racemases, alanine racemases, and/or epimerases of the invention comprise epitopes or purification tags, signal sequences or other fusion sequences, etc. In one aspect, the isomerases, e.g., racemases, e.g., amino acid racemases, alanine racemases, and/or epimerases of the invention can be fused to a random peptide to form a fusion polypeptide. By "fused" or "operably linked" herein is meant that the random peptide and the isomerase, e.g., racemase, e.g., amino acid racemase, alanine racemase, and/or epimerase are linked together, in such a manner as to minimize the disruption to the stability of the structure, e.g., it retains isomerase, e.g., racemase, e.g., amino acid racemase, alanine racemase, and/or epimerase activity. The fusion polypeptide (or fusion polynucleotide encoding the fusion polypeptide) can comprise further components as well, including multiple peptides at multiple loops.

In one aspect, the peptides and nucleic acids encoding them are randomized, either fully randomized or they are biased in their randomization, e.g. in nucleotide/residue frequency generally or per position. "Randomized" means that each nucleic acid and peptide consists of essentially random nucleotides and amino acids, respectively. In one aspect, the nucleic acids which give rise to the peptides can be chemically synthesized, and thus may incorporate any nucleotide at any position. Thus, when the nucleic acids are expressed to form peptides, any amino acid residue may be incorporated at any position. The synthetic process can be designed to generate randomized nucleic acids, to allow the formation of all or most of the possible combinations over the length of the nucleic acid, thus forming a library of randomized nucleic acids. The library can provide a sufficiently structurally diverse population of randomized expression products to affect a probabilistically sufficient range of cellular responses to provide one or more cells exhibiting a desired response. Thus, the invention provides an interaction library large enough so that at least one of its members will have a structure that gives it affinity for some molecule, protein, or other factor.

Isomerases, e.g., racemases, e.g., amino acid racemases, alanine racemases, and/or epimerases are multidomain enzymes that consist in one aspect (optionally) of a signal peptide, a catalytic domain, a linker and/or another catalytic domain.

The invention provides a means for generating chimeric polypeptides which may encode biologically active hybrid polypeptides (e.g., hybrid isomerases, e.g., racemases, e.g., amino acid racemases, alanine racemases, and/or epimerases). In one aspect, the original polynucleotides encode biologically active polypeptides. The method of the invention produces new hybrid polypeptides by utilizing cellular processes which integrate the sequence of the original polynucleotides such that the resulting hybrid polynucleotide encodes a polypeptide demonstrating activities derived from the original biologically active polypeptides. For example, the original polynucleotides may encode a particular enzyme from different microorganisms. An enzyme encoded by a first polynucleotide from one organism or variant may, for example, function effectively under a particular environmental condition, e.g. high salinity. An enzyme encoded by a second polynucleotide from a different organism or variant may function effectively under a different environmental condition, such as extremely high temperatures. A hybrid polynucleotide containing sequences from the first and second original polynucleotides may encode an enzyme which exhibits characteristics of both enzymes encoded by the original polynucleotides. Thus, the enzyme encoded by the hybrid polynucleotide may function effectively under environmental conditions shared by each of the enzymes encoded by the first and second polynucleotides, e.g., high salinity and extreme temperatures.

A hybrid polypeptide resulting from the method of the invention may exhibit specialized enzyme activity not displayed in the original enzymes. For example, following recombination and/or reductive reassortment of polynucleotides encoding isomerase, e.g., racemase, e.g., amino acid racemase, alanine racemase, and/or epimerase activities, the resulting hybrid polypeptide encoded by a hybrid polynucleotide can be screened for specialized isomerase, e.g., racemase, e.g., amino acid racemase, alanine racemase, and/or epimerase activities obtained from each of the original enzymes, i.e. the type of bond on which the isomerase, e.g., racemase, e.g., amino acid racemase, alanine racemase, and/or epimerase acts and the temperature at which the isomerase, e.g., racemase, e.g., amino acid racemase, alanine racemase, and/or epimerase functions. Thus, for example, the isomerase, e.g., racemase, e.g., amino acid racemase, alanine racemase, and/or epimerase may be screened to ascertain those chemical functionalities which distinguish the hybrid isomerase, e.g., racemase, e.g., amino acid racemase, alanine racemase, and/or epimerase from the original isomerases, e.g., racemases, e.g., amino acid racemases, alanine racemases, and/or epimerases, for example, differences in activity at various temperatures, pH or salt concentration.

Sources of the original polynucleotides may be isolated from individual organisms ("isolates"), collections of organisms that have been grown in defined media ("enrichment cultures"), or, uncultivated organisms ("environmental samples"). The use of a culture-independent approach to derive polynucleotides encoding novel bioactivities from environmental samples is most preferable since it allows one to access untapped resources of biodiversity.

"Environmental libraries" are generated from environmental samples and represent the collective genomes of naturally occurring organisms archived in cloning vectors that can be propagated in suitable prokaryotic hosts. Because the cloned DNA is initially extracted directly from environmental samples, the libraries are not limited to the small fraction of prokaryotes that can be grown in pure culture. Additionally, a normalization of the environmental DNA present in these samples could allow more equal representation of the DNA from all of the species present in the original sample. This can dramatically increase the efficiency of finding interesting genes from minor constituents of the sample which may be under-represented by several orders of magnitude compared to the dominant species.

For example, gene libraries generated from one or more uncultivated microorganisms are screened for an activity of interest. Potential pathways encoding bioactive molecules of interest are first captured in prokaryotic cells in the form of gene expression libraries. Polynucleotides encoding activities of interest are isolated from such libraries and introduced into a host cell. The host cell is grown under conditions which promote recombination and/or reductive reassortment creating potentially active biomolecules with novel or enhanced activities.

Additionally, subcloning may be performed to further isolate sequences of interest. In subcloning, a portion of DNA is amplified, digested, generally by restriction enzymes, to cut out the desired sequence, the desired sequence is ligated into a recipient vector and is amplified. At each step in subcloning, the portion is examined for the activity of interest, in order to ensure that DNA that encodes the structural protein has not been excluded. The insert may be purified at any step of the subcloning, for example, by gel electrophoresis prior to ligation into a vector or where cells containing the recipient vector and cells not containing the recipient vector are placed on selective media containing, for example, an antibiotic, which will kill the cells not containing the recipient vector. Specific methods of subcloning cDNA inserts into vectors are well-known in the art (Sambrook et al., *Molecular Cloning: A Laboratory Manual, 2nd Ed.*, Cold Spring Harbor Laboratory Press (1989)). In another aspect, the enzymes of the invention are subclones. Such subclones may differ from the parent clone by, for example, length, a mutation, a tag or a label.

The microorganisms from which the polynucleotide may be prepared include prokaryotic microorganisms, such as *Eubacteria* and *Archaebacteria* and lower eukaryotic microorganisms such as fungi, some algae and protozoa. Polynucleotides may be isolated from environmental samples in which case the nucleic acid may be recovered without culturing of an organism or recovered from one or more cultured organisms. In one aspect, such microorganisms may be extremophiles, such as hyperthermophiles, psychrophiles, psychrotrophs, halophiles, barophiles and acidophiles. Polynucleotides encoding enzymes isolated from extremophilic microorganisms can be used. Such enzymes may function at temperatures above 100° C. in terrestrial hot springs and deep sea thermal vents, at temperatures below 0° C. in arctic waters, in the saturated salt environment of the Dead Sea, at pH values around 0 in coal deposits and geothermal sulfur-rich springs, or at pH values greater than 11 in sewage sludge. For example, several esterases and lipases cloned and expressed from extremophilic organisms show high activity throughout a wide range of temperatures and pHs.

Polynucleotides selected and isolated as hereinabove described are introduced into a suitable host cell. A suitable host cell is any cell which is capable of promoting recombination and/or reductive reassortment. The selected polynucleotides are preferably already in a vector which includes appropriate control sequences. The host cell can be a higher eukaryotic cell, such as a mammalian cell, or a lower eukaryotic cell, such as a yeast cell, or preferably, the host cell can be a prokaryotic cell, such as a bacterial cell. Introduction of the construct into the host cell can be effected by calcium phosphate transfection, DEAE-Dextran mediated transfection, or electroporation (Davis et al., 1986).

As representative examples of appropriate hosts, there may be mentioned: bacterial cells, such as *E. coli, Streptomyces, Salmonella typhimurium*; fungal cells, such as yeast; insect cells such as *Drosophila* S2 and *Spodoptera* Sf9; animal cells such as CHO, COS or Bowes melanoma; adenoviruses; and plant cells. The selection of an appropriate host is deemed to be within the scope of those skilled in the art from the teachings herein.

With particular references to various mammalian cell culture systems that can be employed to express recombinant protein, examples of mammalian expression systems include the COS-7 lines of monkey kidney fibroblasts, described in "SV40-transformed simian cells support the replication of early SV40 mutants" (Gluzman, 1981) and other cell lines capable of expressing a compatible vector, for example, the C127, 3T3, CHO, HeLa and BHK cell lines. Mammalian expression vectors will comprise an origin of replication, a suitable promoter and enhancer and also any necessary ribosome binding sites, polyadenylation site, splice donor and acceptor sites, transcriptional termination sequences and 5' flanking nontranscribed sequences. DNA sequences derived from the SV40 splice and polyadenylation sites may be used to provide the required nontranscribed genetic elements.

In another aspect, it is envisioned the method of the present invention can be used to generate novel polynucleotides encoding biochemical pathways from one or more operons or gene clusters or portions thereof. For example, bacteria and many eukaryotes have a coordinated mechanism for regulating genes whose products are involved in related processes. The genes are clustered, in structures referred to as "gene clusters," on a single chromosome and are transcribed together under the control of a single regulatory sequence, including a single promoter which initiates transcription of the entire cluster. Thus, a gene cluster is a group of adjacent genes that are either identical or related, usually as to their function. An example of a biochemical pathway encoded by gene clusters are polyketides.

Gene cluster DNA can be isolated from different organisms and ligated into vectors, particularly vectors containing expression regulatory sequences which can control and regulate the production of a detectable protein or protein-related array activity from the ligated gene clusters. Use of vectors which have an exceptionally large capacity for exogenous DNA introduction are particularly appropriate for use with such gene clusters and are described by way of example herein to include the f-factor (or fertility factor) of *E. coli*. This f-factor of *E. coli* is a plasmid which affects high-frequency transfer of itself during conjugation and is ideal to achieve and stably propagate large DNA fragments, such as gene clusters from mixed microbial samples. One aspect of the invention is to use cloning vectors, referred to as "fosmids" or bacterial artificial chromosome (BAC) vectors. These are derived from *E. coli* f-factor which is able to stably integrate large segments of genomic DNA. When integrated with DNA from a mixed uncultured environmental sample, this makes it possible to achieve large genomic fragments in the form of a stable "environmental DNA library." Another type of vector for use in the present invention is a cosmid vector. Cosmid vectors were originally designed to clone and propagate large segments of genomic DNA. Cloning into cosmid vectors is described in detail in Sambrook et al., *Molecular Cloning: A Laboratory Manual*, 2nd Ed., Cold Spring Harbor Laboratory Press (1989). Once ligated into an appropriate vector, two or more vectors containing different polyketide synthase gene clusters can be introduced into a suitable host cell. Regions of partial sequence homology shared by the gene clusters will promote processes which result in sequence reorganization resulting in a hybrid gene cluster. The novel hybrid gene cluster can then be screened for enhanced activities not found in the original gene clusters.

Therefore, in a one aspect, the invention relates to a method for producing a biologically active hybrid polypeptide and screening such a polypeptide for enhanced activity by:
1) introducing at least a first polynucleotide in operable linkage and a second polynucleotide in operable linkage, the at least first polynucleotide and second polynucleotide sharing at least one region of partial sequence homology, into a suitable host cell;
2) growing the host cell under conditions which promote sequence reorganization resulting in a hybrid polynucleotide in operable linkage;
3) expressing a hybrid polypeptide encoded by the hybrid polynucleotide;
4) screening the hybrid polypeptide under conditions which promote identification of enhanced biological activity; and
5) isolating the a polynucleotide encoding the hybrid polypeptide.

Methods for screening for various enzyme activities are known to those of skill in the art and are discussed throughout the present specification. Such methods may be employed when isolating the polypeptides and polynucleotides of the invention.

Screening Methodologies and "On-Line" Monitoring Devices

In practicing the methods of the invention, a variety of apparatus and methodologies can be used to in conjunction with the polypeptides and nucleic acids of the invention, e.g., to screen polypeptides for isomerase, e.g., racemase, e.g., amino acid racemase, alanine racemase, and/or epimerase activity, to screen compounds as potential modulators, e.g., activators or inhibitors, of an isomerase, e.g., racemase, e.g., amino acid racemase, alanine racemase, and/or epimerase activity, for antibodies that bind to a polypeptide of the invention, for nucleic acids that hybridize to a nucleic acid of the invention, to screen for cells expressing a polypeptide of the invention and the like. In addition to the array formats described in detail below for screening samples, alternative formats can also be used to practice the methods of the invention. Such formats include, for example, mass spectrometers, chromatographs, e.g., high-throughput HPLC and other forms of liquid chromatography, and smaller formats, such as 1536-well plates, 384—well plates and so on. High throughput screening apparatus can be adapted and used to practice the methods of the invention, see, e.g., U.S. Patent Application No. 20020001809.

Capillary Arrays

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. Capillary arrays, such as the GIGAMATRIX™, Diversa Corporation, San Diego, Calif.; and arrays described in, e.g., U.S. Patent Application No. 20020080350 A1; WO 0231203 A; WO 0244336 A, provide an alternative apparatus for holding and screening samples. In one aspect, the capillary array includes a plurality of capillaries formed into an array of adjacent capillaries, wherein each capillary comprises at least one wall defining a lumen for retaining a sample. The lumen may be cylindrical, square, hexagonal or any other geometric shape so long as the walls form a lumen for retention of a liquid or sample. The capillaries of the capillary array can be held together in close proximity to form a planar structure. The capillaries can be bound together, by being fused (e.g., where the capillaries are made of glass), glued, bonded, or clamped side-by-side. Additionally, the capillary array can include interstitial material disposed between adjacent capillaries in the array, thereby forming a solid planar device containing a plurality of through-holes.

A capillary array can be formed of any number of individual capillaries, for example, a range from 100 to 4,000,000 capillaries. Further, a capillary array having about 100,000 or more individual capillaries can be formed into the standard size and shape of a Microtiter® plate for fitment into standard laboratory equipment. The lumens are filled manually or automatically using either capillary action or microinjection using a thin needle. Samples of interest may subsequently be removed from individual capillaries for further analysis or characterization. For example, a thin, needle-like probe is positioned in fluid communication with a selected capillary to either add or withdraw material from the lumen.

In a single-pot screening assay, the assay components are mixed yielding a solution of interest, prior to insertion into the capillary array. The lumen is filled by capillary action when at least a portion of the array is immersed into a solution of interest. Chemical or biological reactions and/or activity in each capillary are monitored for detectable events. A detectable event is often referred to as a "hit", which can usually be distinguished from "non-hit" producing capillaries by optical detection. Thus, capillary arrays allow for massively parallel detection of "hits".

In a multi-pot screening assay, a polypeptide or nucleic acid, e.g., a ligand, can be introduced into a first component, which is introduced into at least a portion of a capillary of a capillary array. An air bubble can then be introduced into the capillary behind the first component. A second component can then be introduced into the capillary, wherein the second component is separated from the first component by the air bubble. The first and second components can then be mixed by applying hydrostatic pressure to both sides of the capillary array to collapse the bubble. The capillary array is then monitored for a detectable event resulting from reaction or non-reaction of the two components.

In a binding screening assay, a sample of interest can be introduced as a first liquid labeled with a detectable particle into a capillary of a capillary array, wherein the lumen of the capillary is coated with a binding material for binding the detectable particle to the lumen. The first liquid may then be removed from the capillary tube, wherein the bound detectable particle is maintained within the capillary, and a second liquid may be introduced into the capillary tube. The capillary is then monitored for a detectable event resulting from reaction or non-reaction of the particle with the second liquid.

Arrays, or "Biochips"

Nucleic acids and/or polypeptides of the invention can be immobilized to or applied to an array, e.g., a "biochip". Arrays can be used to screen for or monitor libraries of compositions (e.g., small molecules, antibodies, nucleic acids, etc.) for their ability to bind to or modulate the activity of a nucleic acid or a polypeptide of the invention. For example, in one aspect of the invention, a monitored parameter is transcript expression of an isomerase, e.g., racemase, e.g., amino acid racemase, alanine racemase, and/or epimerase gene. One or more, or, all the transcripts of a cell can be measured by hybridization of a sample comprising transcripts of the cell, or, nucleic acids representative of or complementary to transcripts of a cell, by hybridization to immobilized nucleic acids on an array, or "biochip." By using an "array" of nucleic acids on a microchip, some or all of the transcripts of a cell can be simultaneously quantified. Alternatively, arrays comprising genomic nucleic acid can also be used to determine the genotype of a newly engineered strain made by the methods of the invention. Polypeptide arrays" can also be used to simultaneously quantify a plurality of proteins. The present invention can be practiced with any known "array," also referred to as a "microarray" or "nucleic acid array" or "polypeptide array" or "antibody array" or "biochip," or variation thereof. Arrays are generically a plurality of "spots" or "target elements," each target element comprising a defined amount of one or more biological molecules, e.g., oligonucleotides, immobilized onto a defined area of a substrate surface for specific binding to a sample molecule, e.g., mRNA transcripts.

The terms "array" or "microarray" or "biochip" or "chip" as used herein is a plurality of target elements, each target element comprising a defined amount of one or more polypeptides (including antibodies) or nucleic acids immobilized onto a defined area of a substrate surface, as discussed in further detail, below.

In practicing the methods of the invention, any known array and/or method of making and using arrays can be incorporated in whole or in part, or variations thereof, as described, for example, in U.S. Pat. Nos. 6,277,628; 6,277,489; 6,261, 776; 6,258,606; 6,054,270; 6,048,695; 6,045,996; 6,022,963; 6,013,440; 5,965,452; 5,959,098; 5,856,174; 5,830,645; 5,770,456; 5,632,957; 5,556,752; 5,143,854; 5,807,522; 5,800,992; 5,744,305; 5,700,637; 5,556,752; 5,434,049; see also, e.g., WO 99/51773; WO 99/09217; WO 97/46313; WO 96/17958; see also, e.g., Johnston (1998) Curr. Biol. 8:R171-R174; Schummer (1997) Biotechniques 23:1087-1092; Kern (1997) Biotechniques 23:120-124; Solinas-Toldo (1997) Genes, Chromosomes & Cancer 20:399-407; Bowtell (1999) Nature Genetics Supp. 21:25-32. See also published U.S. patent applications Nos. 20010018642; 20010019827; 20010016322; 20010014449; 20010014448; 20010012537; 20010008765.

Antibodies and Antibody-Based Screening Methods

The invention provides isolated, synthetic or recombinant antibodies that specifically bind to an isomerase, e.g., racemase, e.g., amino acid racemase, alanine racemase, and/or epimerase of the invention. These antibodies can be used to isolate, identify or quantify an isomerase, e.g., racemase, e.g., amino acid racemase, alanine racemase, and/or epimerase of the invention or related polypeptides. These antibodies can be used to isolate other polypeptides within the scope the invention or other related isomerases, e.g., racemases, e.g., amino acid racemases, alanine racemases, and/or epimerases. The antibodies can be designed to bind to an active site of an isomerase, e.g., racemase, e.g., amino acid racemase, alanine racemase, and/or epimerase. Thus, the invention provides methods of inhibiting isomerases, e.g., racemases, e.g., amino acid racemases, alanine racemases, and/or epimerases using the antibodies of the invention (see discussion above regarding applications for anti-isomerase, e.g., anti-racemase, e.g., anti-amino acid racemase, anti-alanine racemase, and/or anti-epimerase compositions of the invention).

The invention provides fragments of the enzymes of the invention, including immunogenic fragments of a polypeptide of the invention. The invention provides compositions comprising a polypeptide or peptide of the invention and adjuvants or carriers and the like.

The antibodies can be used in immunoprecipitation, staining, immunoaffinity columns, and the like. If desired, nucleic acid sequences encoding for specific antigens can be generated by immunization followed by isolation of polypeptide or nucleic acid, amplification or cloning and immobilization of polypeptide onto an array of the invention. Alternatively, the methods of the invention can be used to modify the structure of an antibody produced by a cell to be modified, e.g., an antibody's affinity can be increased or decreased. Furthermore, the ability to make or modify antibodies can be a phenotype engineered into a cell by the methods of the invention.

The term "antibody" includes a peptide or polypeptide derived from, modeled after or substantially encoded by an immunoglobulin gene or immunoglobulin genes, or fragments thereof, capable of specifically binding an antigen or epitope, see, e.g. Fundamental Immunology, Third Edition, W. E. Paul, ed., Raven Press, N.Y. (1993); Wilson (1994) J. Immunol. Methods 175:267-273; Yarmush (1992) J. Biochem. Biophys. Methods 25:85-97. The term antibody includes antigen-binding portions, i.e., "antigen binding sites," (e.g., fragments, subsequences, complementarity determining regions (CDRs)) that retain capacity to bind antigen, including (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546), which consists of a VH domain; and (vi) an isolated complementarity determining region (CDR). Single chain antibodies are also included by reference in the term "antibody."

Methods of immunization, producing and isolating antibodies (polyclonal and monoclonal) are known to those of skill in the art and described in the scientific and patent literature, see, e.g., Coligan, CURRENT PROTOCOLS IN IMMUNOLOGY, Wiley/Greene, New York (1991); Stites (eds.) BASIC AND CLINICAL IMMUNOLOGY (7th ed.) Lange Medical Publications, Los Altos, Calif. ("Stites"); Goding, MONOCLONAL ANTIBODIES: PRINCIPLES AND PRACTICE (2d ed.) Academic Press, New York, N.Y. (1986); Kohler (1975) Nature 256:495; Harlow (1988) ANTIBODIES, A LABORATORY MANUAL, Cold Spring Harbor Publications, New York. Antibodies also can be generated in vitro, e.g., using recombinant antibody binding site expressing phage display libraries, in addition to the traditional in vivo methods using animals. See, e.g., Hoogenboom (1997) Trends Biotechnol. 15:62-70; Katz (1997) Annu. Rev. Biophys. Biomol. Struct. 26:27-45.

The polypeptides of The invention or fragments comprising at least 5, 10, 15, 20, 25, 30, 35, 40, 50, 75, 100, or 150 consecutive amino acids thereof, may also be used to generate antibodies which bind specifically to the polypeptides or fragments. The resulting antibodies may be used in immunoaffinity chromatography procedures to isolate or purify the polypeptide or to determine whether the polypeptide is present in a biological sample. In such procedures, a protein preparation, such as an extract, or a biological sample is contacted with an antibody capable of specifically binding to one of the polypeptides of The invention, or fragments comprising at least 5, 10, 15, 20, 25, 30, 35, 40, 50, 75, 100, or 150 consecutive amino acids thereof.

In immunoaffinity procedures, the antibody is attached to a solid support, such as a bead or other column matrix. The protein preparation is placed in contact with the antibody under conditions in which the antibody specifically binds to one of the polypeptides of The invention, or fragment thereof. After a wash to remove non-specifically bound proteins, the specifically bound polypeptides are eluted.

The ability of proteins in a biological sample to bind to the antibody may be determined using any of a variety of procedures familiar to those skilled in the art. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. Particular assays include ELISA assays, sandwich assays, radioimmunoassays and Western Blots.

Polyclonal antibodies generated against the polypeptides of The invention, or fragments comprising at least 5, 10, 15, 20, 25, 30, 35, 40, 50, 75, 100, or 150 or more consecutive amino acids thereof can be obtained by direct injection of the polypeptides into an animal or by administering the polypeptides to an animal, for example, a nonhuman. The antibody so obtained will then bind the polypeptide itself. In this manner, even a sequence encoding only a fragment of the polypeptide can be used to generate antibodies which may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique (Kohler and Milstein, Nature, 256:495-497, 1975), the trioma technique, the human B-cell hybridoma technique (Kozbor et al., Immunology Today 4:72, 1983) and the EBV-hybridoma technique (Cole, et al., 1985, in Monoclonal Antibodies and Cancer Therapy, Alan R. Liss, Inc., pp. 77-96).

Techniques described for the production of single chain antibodies (U.S. Pat. No. 4,946,778) can be adapted to produce single chain antibodies to the polypeptides of The invention, or fragments comprising at least 5, 10, 15, 20, 25, 30, 35, 40, 50, 75, 100, or 150 consecutive amino acids thereof. Alternatively, transgenic mice may be used to express humanized antibodies to these polypeptides or fragments thereof.

Antibodies generated against the polypeptides of The invention, or fragments comprising at least 5, 10, 15, 20, 25, 30, 35, 40, 50, 75, 100, or 150 consecutive amino acids thereof may be used in screening for similar polypeptides from other organisms and samples. In such techniques, polypeptides from the organism are contacted with the antibody and those polypeptides which specifically bind the antibody are detected. Any of the procedures described above may be used to detect antibody binding. One such screening assay is described in "Methods for Measuring Cellulase Activities", *Methods in Enzymology*, Vol 160, pp. 87-116.

Kits

The invention provides kits comprising the compositions, e.g., nucleic acids, expression cassettes, vectors, cells, transgenic seeds or plants or plant parts, polypeptides (e.g., isomerases, e.g., racemases, e.g., amino acid racemases, alanine racemases, and/or epimerases) and/or antibodies of the invention. The kits also can contain instructional material teaching the methodologies and industrial, research, medical, pharmaceutical, food and feed and food and feed supplement processing and other applications and processes of the invention, as described herein.

Whole Cell Engineering and Measuring Metabolic Parameters

The methods of the invention provide whole cell evolution, or whole cell engineering, of a cell to develop a new cell strain having a new phenotype, e.g., a new or modified isomerase, e.g., racemase, e.g., amino acid racemase, alanine racemase, and/or epimerase activity, by modifying the genetic composition of the cell. The genetic composition can be modified by addition to the cell of a nucleic acid of the invention, e.g., a coding sequence for an enzyme of the invention. See, e.g., WO0229032; WO0196551.

To detect the new phenotype, at least one metabolic parameter of a modified cell is monitored in the cell in a "real time" or "on-line" time frame. In one aspect, a plurality of cells, such as a cell culture, is monitored in "real time" or "on-line." In one aspect, a plurality of metabolic parameters is monitored in "real time" or "on-line." Metabolic parameters can be monitored using the isomerases, e.g., racemases, e.g., amino acid racemases, alanine racemases, and/or epimerases of the invention.

Metabolic flux analysis (MFA) is based on a known biochemistry framework. A linearly independent metabolic matrix is constructed based on the law of mass conservation and on the pseudo-steady state hypothesis (PSSH) on the intracellular metabolites. In practicing the methods of the invention, metabolic networks are established, including the:

identity of all pathway substrates, products and intermediary metabolites identity of all the chemical reactions interconverting the pathway metabolites, the stoichiometry of the pathway reactions, identity of all the enzymes catalyzing the reactions, the enzyme reaction kinetics, the regulatory interactions between pathway components, e.g. allosteric interactions, enzyme-enzyme interactions etc, intracellular compartmentalization of enzymes or any other supramolecular organization of the enzymes, and, the presence of any concentration gradients of metabolites, enzymes or effector molecules or diffusion barriers to their movement.

Once the metabolic network for a given strain is built, mathematic presentation by matrix notion can be introduced to estimate the intracellular metabolic fluxes if the on-line metabolome data is available. Metabolic phenotype relies on the changes of the whole metabolic network within a cell. Metabolic phenotype relies on the change of pathway utilization with respect to environmental conditions, genetic regulation, developmental state and the genotype, etc. In one aspect of the methods of the invention, after the on-line MFA calculation, the dynamic behavior of the cells, their phenotype and other properties are analyzed by investigating the pathway utilization. For example, if the glucose supply is increased and the oxygen decreased during the yeast fermentation, the utilization of respiratory pathways will be reduced and/or stopped, and the utilization of the fermentative pathways will dominate. Control of physiological state of cell cultures will become possible after the pathway analysis. The methods of the invention can help determine how to manipulate the fermentation by determining how to change the substrate supply, temperature, use of inducers, etc. to control the physiological state of cells to move along desirable direction. In practicing the methods of the invention, the MFA results can also be compared with transcriptome and proteome data to design experiments and protocols for metabolic engineering or gene shuffling, etc.

In practicing the methods of the invention, any modified or new phenotype can be conferred and detected, including new or improved characteristics in the cell. Any aspect of metabolism or growth can be monitored.

Monitoring Expression of an mRNA Transcript

In one aspect of the invention, the engineered phenotype comprises increasing or decreasing the expression of an mRNA transcript (e.g., an isomerase, e.g., racemase, e.g., amino acid racemase, alanine racemase, and/or epimerase message) or generating new (e.g., isomerase, e.g., racemase, e.g., amino acid racemase, alanine racemase, and/or epimerase) transcripts in a cell. This increased or decreased expression can be traced by testing for the presence of an isomerase, e.g., racemase, e.g., amino acid racemase, alanine racemase, and/or epimerase of the invention or by isomerase, e.g., racemase, e.g., amino acid racemase, alanine racemase, and/or epimerase activity assays. mRNA transcripts, or messages, also can be detected and quantified by any method known in the art, including, e.g., Northern blots, quantitative amplification reactions, hybridization to arrays, and the like. Quantitative amplification reactions include, e.g., quantitative PCR, including, e.g., quantitative reverse transcription polymerase chain reaction, or RT-PCR; quantitative real time RT-PCR, or "real-time kinetic RT-PCR" (see, e.g., Kreuzer (2001) Br. J. Haematol. 114:313-318; Xia (2001) Transplantation 72:907-914).

In one aspect of the invention, the engineered phenotype is generated by knocking out expression of a homologous gene. The gene's coding sequence or one or more transcriptional control elements can be knocked out, e.g., promoters or enhancers. Thus, the expression of a transcript can be completely ablated or only decreased.

In one aspect of the invention, the engineered phenotype comprises increasing the expression of a homologous gene. This can be effected by knocking out of a negative control element, including a transcriptional regulatory element acting in cis- or trans-, or, mutagenizing a positive control element. One or more, or, all the transcripts of a cell can be measured by hybridization of a sample comprising transcripts of the cell, or, nucleic acids representative of or complementary to transcripts of a cell, by hybridization to immobilized nucleic acids on an array.

Monitoring Expression of a Polypeptides, Peptides and Amino Acids

In one aspect of the invention, the engineered phenotype comprises increasing or decreasing the expression of a polypeptide (e.g., an isomerase, e.g., racemase, e.g., amino acid racemase, alanine racemase, and/or epimerase) or generating new polypeptides in a cell. This increased or decreased expression can be traced by determining the amount of isomerase, e.g., racemase, e.g., amino acid racemase, alanine racemase, and/or epimerase present or by isomerase, e.g., racemase, e.g., amino acid racemase, alanine racemase, and/or epimerase activity assays. Polypeptides, peptides and amino acids also can be detected and quantified by any method known in the art, including, e.g., nuclear magnetic resonance (NMR), spectrophotometry, radiography (protein radiolabeling), electrophoresis, capillary electrophoresis, high performance liquid chromatography (HPLC), thin layer chromatography (TLC), hyperdiffusion chromatography, various immunological methods, e.g. immunoprecipitation, immunodiffusion, immuno-electrophoresis, radioimmunoassays (RIAs), enzyme-linked immunosorbent assays (ELISAs), immuno-fluorescent assays, gel electrophoresis (e.g., SDS-PAGE), staining with antibodies, fluorescent activated cell sorter (FACS), pyrolysis mass spectrometry, Fourier-Transform Infrared Spectrometry, Raman spectrometry, GC-MS, and LC-Electrospray and cap-LC-tandem-electrospray mass spectrometries, and the like. Novel bioactivities can also be screened using methods, or variations thereof, described in U.S. Pat. No. 6,057,103. Furthermore, as discussed below in detail, one or more, or, all the polypeptides of a cell can be measured using a protein array.

Industrial, Energy, Pharmaceutical, Medical, Food Processing and Other Applications Polypeptides of the invention can be used in or to make any industrial, agricultural, food and feed and food and feed supplement or food or feed additive, pharmaceutical, medical, research (laboratory) or other compositions or process. The invention provides industrial processes using enzymes of the invention, e.g., in the pharmaceutical or nutrient (diet) supplement industry, the energy industry (e.g., to make "clean" biofuels), in the food and feed industries, e.g., in methods for making food and feed products and food and feed additives. In one aspect, the invention provides processes using enzymes of the invention in the medical industry, e.g., to make pharmaceuticals, pharmaceutical intermediates, or dietary aids or supplements, or food supplements and additives. In addition, the invention provides methods for using the enzymes of the invention in biofuel production, including, e.g., a bioalcohol such as bioethanol, biomethanol, biobutanol or biopropanol, thus comprising a "clean" fuel production.

The isomerase, e.g., racemase, e.g., amino acid racemase, alanine racemase, and/or epimerase enzymes of the invention can be highly selective catalysts. They can catalyze reactions with exquisite stereo-, regio- and chemo-selectivities that are unparalleled in conventional synthetic chemistry. Moreover, enzymes are remarkably versatile. The isomerase, e.g., racemase, e.g., amino acid racemase, alanine racemase, and/or epimerase enzymes of the invention can be tailored to function in organic solvents, operate at extreme pHs (for example, high pHs and low pHs) extreme temperatures (for example, high temperatures and low temperatures), extreme salinity levels (for example, high salinity and low salinity) and catalyze reactions with compounds that are structurally unrelated to their natural, physiological substrates.

In one aspect, the isomerases, e.g., racemases, e.g., amino acid racemases (e.g., resolving a D- and/or an L-isomer from a racemic mixture), alanine racemases, and/or epimerases of the invention are used in processes in the manufacture of medicaments (pharmaceuticals, drugs, and/or their precursors or intermediates), pesticides and/or their precursors or intermediates thereof. For example, D-serine can be useful for binding to NMDA brain receptors to promote neuromodulation, or D-aspartate can be useful for hormonal regulation in endocrine tissues.

In one aspect, the invention uses an amino acid racemase of this invention to make (resolve) a D-amino acid by using a racemic and/or an L-amino acid source, the process comprising enzyme reaction on a specific amino acid of interest. In one aspect, the invention uses an amino acid racemase of this invention to make a D-amino acid (from a racemate and/or an L-amino acid source) resistant to proteolysis. In one aspect, the invention uses an amino acid racemase of this invention to make (resolve) proteins comprising D-amino acids (from racemates and/or L-amino acid sources) to generate a new or enhanced antibiotic or immunogenic property.

In one embodiment, the isomerase, e.g., racemase, e.g., amino acid racemase, alanine racemase, and/or epimerase enzymes of the invention are used as targets for examining protein turnover in response to a pathological or biological process, e.g. liver damage/disease or myocardial infarction. In one exemplary transamination reaction using an enzyme of the invention, an alpha-amino group is transferred to an alpha-carbon atom of an alpha-ketoglutarate generating the corresponding alpha-keto acid analog of the amino acid.

Detergent, Disinfectant and Cleaning Compositions

The invention provides cleaning compositions, e.g., detergent, disinfectant or cleanser (cleaning or cleansing) compositions, e.g. for cleaning fabrics, dishwashing, laundry, oral cleaning, denture cleaning, and contact lenses, comprising one or more polypeptides (e.g., isomerases, e.g., racemases, e.g., amino acid racemases, alanine racemases, and/or epimerases) of the invention, and methods of making and using these compositions. The invention incorporates all methods of making and using detergent, disinfectant or cleanser compositions, see, e.g., U.S. Pat. Nos. 6,413,928; 6,399,561; 6,365,561; 6,380,147. The detergent, disinfectant or cleanser compositions can be a one and two part aqueous composition, a non-aqueous liquid composition, a cast solid, a granular form, a particulate form, a compressed tablet, a gel and/or a paste and a slurry form. The isomerases, e.g., racemases, e.g., amino acid racemases, alanine racemases, and/or epimerases of the invention can also be used as a detergent, disinfectant or cleanser additive product in a solid or a liquid form. Such additive products are intended to supplement or boost the performance of conventional detergent compositions and can be added at any stage of the cleaning process.

The actual active enzyme content depends upon the method of manufacture of a detergent, disinfectant or cleanser composition and is not critical, assuming the detergent solution has the desired enzymatic activity. In one aspect, the amount of isomerase, e.g., racemase, e.g., amino acid racemase, alanine racemase, and/or epimerase present in the final solution ranges from about 0.001 mg to 0.5 mg per gram of the detergent composition. The particular enzyme chosen for use in the process and products of this invention depends upon the conditions of final utility, including the physical product form, use pH, use temperature, and soil types to be degraded or altered. The enzyme can be chosen to provide optimum activity and stability for any given set of utility conditions. In one aspect, the isomerases, e.g., racemases, e.g., amino acid racemases, alanine racemases, and/or epimerases of the present invention are active in the pH ranges of from about 4 to about 12 and in the temperature range of from about 20° C. to about 95° C. The detergents of the invention can comprise cationic, semi-polar nonionic or zwitterionic surfactants; or, mixtures thereof.

Isomerases, e.g., racemases, e.g., amino acid racemases, alanine racemases, and/or epimerases of the invention can be formulated into powdered and liquid detergents, disinfectants or cleansers having pH between 4.0 and 12.0 at levels of about 0.01 to about 5% (preferably 0.1% to 0.5%) by weight. These detergent, disinfectant or cleanser compositions can also include other isomerases, e.g., racemases, e.g., amino acid racemases, alanine racemases, and/or epimerases and/or other enzymes such as xylanases, cellulases, lipases, esterases, proteases, or endoglycosidases, endo-beta.-1,4-glucanases, beta-glucanases, endo-beta-1,3(4)-glucanases, cutinases, peroxidases, catalases, laccases, amylases, glucoamylases, pectinases, oxidoreductases, reductases, oxidases, transferases, transaminases, amino transferases, dehydrogenases, phenoloxidases, ligninases, pullulanases, arabinanases, hemicellulases, mannanases, xyloglucanases, pectin acetyl esterases, rhamnogalacturonan acetyl esterases, polygalacturonases, rhamnogalacturonases, galactanases, pectin lyases, pectin methylesterases, cellobiohydrolases and/or transglutaminases. These detergent, disinfectant or cleanser compositions can also include dyes, colorants, odorants, bleaches, buffers, builders, enzyme "enhancing agents" (see, e.g., U.S. Patent application no. 20030096394) and stabilizers.

In one aspect, the invention provides a method for cleaning or washing an object comprising contacting the object with a polypeptide of the invention under conditions sufficient for cleaning or washing. An isomerase, e.g., racemase, e.g., amino acid racemase, alanine racemase, and/or epimerase of the invention may be included as a detergent, disinfectant or cleanser additive. A fabric softener composition can comprise an isomerase, e.g., racemase, e.g., amino acid racemase, alanine racemase, and/or epimerase of the invention.

Treating Foods and Food Processing

The isomerases, e.g., racemases, e.g., amino acid racemases, alanine racemases, and/or epimerases of the invention have numerous applications in food processing industry. For example, in one aspect, the isomerases, e.g., racemases, e.g., amino acid racemases, alanine racemases, and/or epimerases of the invention are used to improve the extraction of oil from oil-rich plant material, e.g., oil-rich seeds, for example, soybean oil from soybeans, olive oil from olives, rapeseed oil from rapeseed and/or sunflower oil from sunflower seeds. In another aspect, the isomerases, e.g., racemases, e.g., amino acid racemases, alanine racemases, and/or epimerases of the invention can be used for separation of components of plant cell materials.

The isomerases, e.g., racemases, e.g., amino acid racemases, alanine racemases, and/or epimerases of the invention can be used in the preparation of fruit or vegetable juices, syrups, extracts and the like to increase yield. The isomerases, e.g., racemases, e.g., amino acid racemases, alanine racemases, and/or epimerases of the invention can be used in the enzymatic treatment of various plant cell wall-derived materials or waste materials, e.g. from cereals, grains, wine or juice production, or agricultural residues such as vegetable hulls, bean hulls, sugar beet pulp, olive pulp, potato pulp, and the like. The isomerases, e.g., racemases, e.g., amino acid racemases, alanine racemases, and/or epimerases of the invention can be used to modify the consistency and appearance of processed fruit or vegetables. The isomerases, e.g., racemases, e.g., amino acid racemases, alanine racemases, and/or epimerases of the invention can be used to treat plant material to facilitate processing of plant material, including foods, facilitate purification or extraction of plant components.

In one aspect, isomerases, e.g., racemases, e.g., amino acid racemases, alanine racemases, and/or epimerases of the invention are used in baking applications, e.g., cookies, breads and crackers. In one aspect, isomerases, e.g., racemases, e.g., amino acid racemases, alanine racemases, and/or epimerases of the invention are used as additives in dough processing. In another aspect of the invention, the isomerases, e.g., racemases, e.g., amino acid racemases, alanine racemases, and/or epimerases of the invention can also be used in any food or beverage treatment or food or beverage production process. In another aspect of the invention, the isomerases, e.g., racemases, e.g., amino acid racemases, alanine racemases, and/or epimerases of the invention can be included in any food or beverage composition.

Feeds and Food or Feed or Food Additives

The invention provides methods for treating feeds, foods, food or feed additives, food or feed supplements, or dietary aids, using isomerases, e.g., racemases, e.g., amino acid racemases, alanine racemases, and/or epimerases of the invention, animals including mammals (e.g., humans), birds, fish and the like. The invention provides feeds, foods, food or feed additives, food or feed supplements, or dietary aids comprising isomerases, e.g., racemases, e.g., amino acid racemases, alanine racemases, and/or epimerases of the invention. In one aspect, treating feeds, foods, food or feed additives, food or feed supplements, or dietary aids using isomerases, e.g., racemases, e.g., amino acid racemases, alanine racemases, and/or epimerases of the invention can help in the availability of nutrients, e.g., starch, protein, sugars, and the like, in the feeds, foods, food or feed additives, food or feed supplements, or dietary aids.

The feeds, foods, food or feed additives, food or feed supplements, or dietary aids of the invention may be a granulated, pelletized or particulate form, which may be coated or uncoated. Alternatively, the feeds, foods, food or feed additives, food or feed supplements, or dietary aids of the invention may be a stabilized liquid composition. This may be an aqueous or oil-based slurry. See, e.g., U.S. Pat. No. 6,245,546.

In another aspect, isomerases, e.g., racemases, e.g., amino acid racemases, alanine racemases, and/or epimerases of the invention can be supplied by expressing the enzymes directly in transgenic feed crops (as, e.g., transgenic plants, seeds and the like), such as grains, cereals, corn, soy bean, rape seed, lupin and the like. As discussed above, the invention provides transgenic plants, plant parts and plant cells comprising a nucleic acid sequence encoding a polypeptide of the invention. In one aspect, the nucleic acid is expressed such that the isomerase, e.g., racemase, e.g., amino acid racemase, alanine racemase, and/or epimerase of the invention is produced in recoverable quantities. The isomerases, e.g., racemases, e.g., amino acid racemases, alanine racemases, and/or epimerases can be recovered from any plant or plant part. Alternatively, the plant or plant part containing the recombinant polypeptide can be used as such for improving the quality of a food or feed, e.g., improving nutritional value, palatability, and rheological properties, or to destroy an antinutritive factor.

A coating can be applied to the invention enzyme granules, pellets, particles for many different purposes, such as to add a flavor or nutrition supplement, to delay release nutrients and enzymes in gastric conditions, and the like. Or, the coating may be applied to achieve a functional goal, for example, whenever it is desirable to slow release of the enzyme from the matrix particles or to control the conditions under which the enzyme will be released. The composition of the coating material can be such that it is selectively broken down by an agent to which it is susceptible (such as heat, acid or base, enzymes or other chemicals). Alternatively, two or more coatings susceptible to different such breakdown agents may be consecutively applied to the matrix particles.

The invention is also directed towards a process for preparing an enzyme-releasing matrix. In accordance with the invention, the process comprises providing discrete plural particles of a grain-based substrate in a particle size suitable for use as an enzyme-releasing matrix, wherein the particles comprise an isomerase, e.g., racemase, e.g., amino acid racemase, alanine racemase, and/or epimerase enzyme encoded by an amino acid sequence of the invention or at least 30 consecutive amino acids thereof. Preferably, the process includes compacting or compressing the particles of enzyme-releasing matrix into granules, which can be accomplished by pelletizing. The mold inhibitor and cohesiveness agent, when used, can be added at any suitable time, and can be mixed with the grain-based substrate in the desired proportions prior to pelletizing of the grain-based substrate. Moisture content in the pellet mill feed can be in the ranges set forth above with respect to the moisture content in the finished product, and can be about 14-15%. In one aspect, moisture is added to the feedstock in the form of an aqueous preparation of the enzyme to bring the feedstock to this moisture content. The temperature in the pellet mill can be brought to about 82° C. with steam. The pellet mill may be operated under any conditions that impart sufficient work to the feedstock to provide pellets. The pelleting process itself is a cost-effective process for removing water from the enzyme-containing composition.

In one aspect, the pellet mill is operated with a ⅛ in. by 2 inch die at 100 lb./min. pressure at 82° C. to provide pellets, which then are crumbled in a pellet mill crumbler to provide discrete plural particles having a particle size capable of passing through an 8 mesh screen but being retained on a 20 mesh screen.

The thermostable isomerases, e.g., racemases, e.g., amino acid racemases, alanine racemases, and/or epimerases of the invention can be used in the pellets of the invention. They can have high optimum temperatures and high heat resistance such that an enzyme reaction at a temperature not hitherto carried out can be achieved. The gene encoding the isomerase, e.g., racemase, e.g., amino acid racemase, alanine racemase, and/or epimerase according to the present invention (e.g. as set forth in any of the sequences in the invention) can be used in preparation of isomerases, e.g., racemases, e.g., amino acid racemases, alanine racemases, and/or epimerases (e.g. using GSSM as described herein) having characteristics different from those of the isomerases, e.g., racemases, e.g., amino acid racemases, alanine racemases, and/or epimerases of the invention (in terms of optimum pH, optimum temperature, heat resistance, stability to solvents, specific activity, affinity to substrate, secretion ability, translation rate, transcription control and the like).

Waste Treatment

The isomerases, e.g., racemases, e.g., amino acid racemases, alanine racemases, and/or epimerases of the invention can be used in a variety of other industrial applications, e.g., in waste treatment. For example, in one aspect, the invention provides a solid waste digestion process using isomerase, e.g., racemase, e.g., amino acid racemase, alanine racemase, and/or epimerase of the invention. The methods can comprise reducing the mass and volume of substantially untreated solid waste. Solid waste can be treated with an enzymatic digestive process in the presence of an enzymatic solution (including isomerase, e.g., racemase, e.g., amino acid racemase, alanine racemase, and/or epimerase of the invention) at a controlled temperature. This results in a reaction without appreciable bacterial fermentation from added microorganisms. The solid waste is converted into a liquefied waste and any residual solid waste. The resulting liquefied waste can be separated from said any residual solidified waste. See e.g., U.S. Pat. No. 5,709,796.

In another aspect of the invention, the isomerase, e.g., racemase, e.g., amino acid racemase, alanine racemase, and/or epimerase of the invention can also be used in any waste treatment process. In another aspect of the invention, the isomerase, e.g., racemase, e.g., amino acid racemase, alanine racemase, and/or epimerase of the invention can be included in any waste treatment composition.

Oral Care Products

The invention provides oral care products comprising enzymes of this invention, such as trans isomerases, e.g., racemases, e.g., amino acid racemases, alanine racemases, and/or epimerases of the invention, including the enzyme mixtures or "cocktails" of the invention. Exemplary oral care products include toothpastes, dental creams, gels or tooth powders, odontics, mouth washes, pre- or post brushing rinse formulations, chewing gums, lozenges, or candy. See, e.g., U.S. Pat. No. 6,264,925.

Biomass Conversion and Biofuel Production

The invention provides methods and processes for biomass conversion or any organic material to a fuel, e.g., to a fuel, e.g. a biofuel, such as bioethanol, biomethanol, biopropanol and/or biobutanol and the like, using enzymes of the invention, including the enzyme mixtures or "cocktails" of the invention. Thus, the invention provides fuels, e.g., biofuels, such as bioethanols, comprising a polypeptide of the invention, including the enzyme mixtures or "cocktails" of the invention, or a polypeptide encoded by a nucleic acid of the invention. In alternative aspects, the fuel is derived from a plant material, which optionally comprises potatoes, soybean (rapeseed), barley, rye, corn, oats, wheat, beets or sugar cane, and optionally the fuel comprises a bioethanol or a gasoline-ethanol mix.

The invention provides methods for making a fuel comprising contacting a biomass composition or any organic material with a polypeptide of the invention, or a polypeptide encoded by a nucleic acid of the invention, or any one of the mixtures or "cocktails" or products of manufacture of the invention. In alternative embodiments, the biomass composition comprises a plant, plant product or plant derivative, and the plant or plant product can comprise cane sugar plants or plant products, beets or sugarbeets, wheat, corn, soybeans, potato, rice or barley. In one aspect, the fuel comprises a bioethanol or a gasoline-ethanol mix, or a biopropanol or a gasoline-propanol mix, or a biobutanol or a gasoline-butanol mix, or a biomethanol or a gasoline-methanol mix, or a biodiesel or a gasoline-biodiesel mix, or any combination thereof.

The invention provides methods for making bioethanol, biobutanol, biomethanol and/or a biopropanol comprising contacting a biomass composition or any organic material with a polypeptide of the invention, or a polypeptide encoded by a nucleic acid of the invention, or any one of the mixtures or "cocktails" or products of manufacture of the invention. In alternative embodiments, the biomass composition comprises a plant, plant product or plant derivative, and the plant or plant product can comprise cane sugar plants or plant products, beets or sugarbeets, wheat, corn, soybeans, potato, rice or barley. In alternative embodiments, the organic material or biomass is derived from an agricultural crop (e.g., wheat, barley, potatoes, switchgrass, poplar wood), is a byproduct of a food or a feed production, is a lignocellulosic waste product, or is a plant residue or a waste paper or waste paper product, and optionally the plant residue comprise stems, leaves, hulls, husks, corn or corn cobs, corn stover, corn fiber, hay, straw (e.g. rice straw or wheat straw), sugarcane bagasse, sugar beet pulp, citrus pulp, and citrus peels, wood, wood thinnings, wood chips, wood pulp, pulp waste, wood waste, wood shavings and sawdust, construction and/or demolition wastes and debris (e.g. wood, wood shavings and sawdust), and optionally the paper waste comprises discarded or used photocopy paper, computer printer paper, notebook paper, notepad paper, typewriter paper, newspapers, magazines, cardboard and paper-based packaging materials, and recycled paper materials. In addition, urban wastes, e.g. the paper fraction of municipal solid waste, municipal wood waste, and municipal green waste, can be used.

The invention provides compositions (including products of manufacture, enzyme ensembles, or "cocktails") comprising a mixture (or "cocktail") of isomerase, e.g., racemase, e.g., amino acid racemase, alanine racemase, and/or epimerase enzymes.

The invention provides cells and/or organisms expressing enzymes of the invention (e.g., wherein the cells or organisms comprise as heterologous nucleic acids a sequence of this invention) for participation in chemical cycles involving natural biomass (e.g., plant) conversion. Alternatively, the polypeptide of the invention may be expressed in the biomass plant material or feedstock itself.

The methods of the invention also include taking the converted biomass (e.g., lignocellulosic) material (processed by enzymes of the invention) and making it into a fuel (e.g. a biofuel such as a bioethanol, biobutanol, biomethanol, a biopropanol, or a biodiesel) by fermentation and/or by chemical synthesis. In one aspect, the produced sugars are fermented and/or the non-fermentable products are gasified.

The methods of the invention also include converting algae, virgin vegetable oils, waste vegetable oils, animal fats and greases (e.g. tallow, lard, and yellow grease), or sewage, using enzymes of the invention, and making it into a fuel (e.g. a bioalcohol, e.g., a bioethanol, biomethanol, biobutanol or biopropanol, or biodiesel) by fermentation and/or by chemical synthesis or conversion.

The enzymes of the invention (including, for example, organisms, such as microorganisms, e.g., fungi, yeast or bacteria, and plants and plant cells and plant parts, e.g., seeds, making and in some aspects secreting recombinant enzymes of the invention) can be used in or included/integrated at any stage of any organic matter/biomass conversion process, e.g., at any one step, several steps, or included in all of the steps, or all of the following methods of biomass conversion processes, or all of these biofuel alternatives:

Direct combustion: the burning of material by direct heat and is the simplest biomass technology; can be very economical if a biomass source is nearby.

1 Pyrolysis: is the thermal degradation of biomass by heat in the absence of oxygen. In one aspect, biomass is heated to a temperature between about 800 and 1400 degrees Fahrenheit, but no oxygen is introduced to support combustion resulting in the creation of gas, fuel oil and charcoal.

2 Gasification: biomass can be used to produce methane through heating or anaerobic digestion. Syngas, a mixture of carbon monoxide and hydrogen, can be derived from biomass.

Landfill Gas: is generated by the decay (anaerobic digestion) of buried garbage in landfills. When the organic waste decomposes, it generates gas consisting of approximately 50% methane, the major component of natural gas.

Anaerobic digestion: converts organic matter to a mixture of methane, the major component of natural gas, and carbon dioxide. In one aspect, biomass such as waterwaste (sewage), manure, or food processing waste, is mixed with water and fed into a digester tank without air.

Fermentation

Alcohol Fermentation: fuel alcohol is produced by converting cellulosic mass and/or starch to sugar, fermenting the sugar to alcohol, then separating the alcohol water mixture by distillation. Feedstocks such as dedicated crops (e.g., wheat, barley, potatoes, switchgrass, poplar wood), agricultural residues and wastes (e.g. rice straw, corn stover, wheat straw, sugarcane bagasse, rice hulls, corn fiber, sugar beet pulp, citrus pulp, and citrus peels), forestry wastes (e.g. hardwood and softwood thinnings, hardwood and softwood residues from timber operations, wood shavings, and sawdust), urban wastes (e.g. paper fraction of municipal solid waste, municipal wood waste, municipal green waste), wood wastes (e.g. saw mill waste, pulp mill waste, construction waste, demolition waste, wood shavings, and sawdust), and waste paper or other materials containing sugar, starch, and/or cellulose can be converted to sugars and then to alcohol by fermentation with yeast. Alternatively, materials containing sugars can be converted directly to alcohol by fermentation.

Transesterification: An exemplary reaction for converting oil to biodiesel is called transesterification. The transesterification process reacts an alcohol (like methanol) with the triglyceride oils contained in vegetable oils, animal fats, or recycled greases, forming fatty acid alkyl esters (biodiesel) and glycerin. The reaction requires heat and a strong base catalyst, such as sodium hydroxide or potassium hydroxide.

Biodiesel: Biodiesel is a mixture of fatty acid alkyl esters made from vegetable oils, animal fats or recycled greases. Biodiesel can be used as a fuel for vehicles in its pure form, but it is usually used as a petroleum diesel additive to reduce levels of particulates, carbon monoxide, hydrocarbons and air toxics from diesel-powered vehicles.

Hydrolysis: includes hydrolysis of a compound, e.g., a biomass, such as a lignocellulosic material, catalyzed using an enzyme of the instant invention.

Cogeneration: is the simultaneous production of more than one form of energy using a single fuel and facility. In one aspect, biomass cogeneration has more potential growth than biomass generation alone because cogeneration produces both heat and electricity.

Enzymes of the invention can also be used in glycerin refining. The glycerin by-product contains unreacted catalyst and soaps that are neutralized with an acid. Water and alcohol are removed to produce 50% to 80% crude glycerin. The remaining contaminants include unreacted fats and oils, which can be processes using the polypeptides of the invention. In a large biodiesel plants of the invention, the glycerin can be further purified, e.g., to 99% or higher purity, for the pharmaceutical and cosmetic industries.

Biofuels as a Liquid or a Gas Gasoline

The invention provides biofuels and synthetic fuels in the form of a gas, or gasoline, e.g., a syngas. In one aspect, methods of the invention comprising use of enzymes of the invention for chemical cycles for natural biomass conversion, e.g., for the hydrolysis of a biomass to make a biofuel, e.g., a bioethanol, biopropanol, bio-butanol or a biomethanol, or a synthetic fuel, in the form of a liquid or as a gas, such as a "syngas".

For example, invention provides methods for making biofuel gases and synthetic gas fuels ("syngas") comprising a bioethanol, biopropanol, bio-butanol and/or a biomethanol made using a polypeptide of the invention, or made using a method of the invention; and in one aspect this biofuel gas of the invention is mixed with a natural gas (can also be produced from biomass), e.g., a hydrogen or a hydrocarbon-based gas fuel. In one aspect, the invention provides methods for processing biomass to a synthetic fuel, e.g., a syngas, such as a syngas produced from a biomass by gasification. In one aspect, the invention provides methods for making an ethanol, propanol, butanol and/or methanol gas from a sugar cane, e.g., a bagasse. In one aspect, this fuel, or gas, is used as motor fuel, e.g., an automotive, truck, airplane, boat, small engine, etc. fuel. In one aspect, the invention provides methods for making an ethanol, propanol, butanol and/or methanol from a plant, e.g., corn, or a plant product, e.g., hay or straw (e.g., a rice straw or a wheat straw, or any the dry stalk of any cereal plant), or an agricultural waste product.

In one aspect, the ethanol, propanol, butanol and/or methanol made using a method of composition of the invention can be used as a fuel (e.g., a gasoline) additive (e.g., an oxygenator) or in a direct use as a fuel. For example, a ethanol, propanol, butanol and/or methanol, including a fuel, made by a method of the invention can be mixed with ethyl tertiary butyl ether (ETBE), or an ETBE mixture such as ETBE containing 47% ethanol as a biofuel, or with MTBE (methyl tertiary-butyl ether). In another aspect, a ethanol, propanol, butanol and/or methanol, including a fuel, made by a method of the invention can be mixed with:

| IUPAC name | Common name |
|---|---|
| but-1-ene | α-butylene |
| cis-but-2-ene | cis-β-butylene |
| trans-but-2-ene | trans-β-butylene |
| 2-methylpropene | isobutylene |

A butanol and/or ethanol made by a method of the invention (e.g., using an enzyme of the invention) can be further processed using "A.B.E." (Acetone, Butanol, Ethanol) fermentation; in one aspect, butanol being the only liquid product. In one aspect, this butanol and/or ethanol is burned "straight" in existing gasoline engines (without modification to the engine or car), produces more energy and is less corrosive and less water soluble than ethanol, and can be distributed via existing infrastructures.

In one aspect, one, several or all of these alcohols are made by a process of the invention using an enzyme of the invention, and the process can further comprise a biomass-to-liquid technology, e.g., a gasification process to produce syngas followed by catalytic synthesis, or by a bioconversion of biomass to a mixed alcohol fuel.

The invention also provides processes comprising use of an enzyme of the invention incorporating (or, incorporated into) "gas to liquid", or GTL; or "coal to liquid", or CTL; or "biomass to liquid" or BTL; or "oilsands to liquid", or OTL, processes; and in one aspect these processes of the invention are used to make synthetic fuels. In one aspect, one of these processes of the invention comprises making a biofuel (e.g., a synfuel) out of a biomass using, e.g., the so-called "Fischer Tropsch" process (a catalyzed chemical reaction in which carbon monoxide and hydrogen are converted into liquid hydrocarbons of various forms; typical catalysts used are based on iron and cobalt; the principal purpose of this process is to produce a synthetic petroleum substitute for use as synthetic lubrication oil or as synthetic fuel). In one aspect, this synthetic biofuel of the invention can contain oxygen and can be used as additive in high quality diesel and petrol.

In alternative aspects, the processes of the invention use various pretreatments, which can be grouped into three categories: physical, chemical, and multiple (physical+chemical). Any chemicals can be used as a pretreatment agent, e.g., acids, alkalis, gases, cellulose solvents, alcohols, oxidizing agents and reducing agents. Among these chemicals, alkali is the most popular pretreatment agent because it is relatively inexpensive and results in less cellulose degradation. The common alkalis sodium hydroxide and lime also can be used as pretreatment agents. Although sodium hydroxide increases biomass digestibility significantly, it is difficult to recycle, is relatively expensive, and is dangerous to handle. In contrast, lime has many advantages: it is safe and very inexpensive, and can be recovered by carbonating wash water with carbon dioxide.

In one aspect, the invention provides a biofuel, e.g., a biogas, produced by the process of anaerobic digestion of organic material by anaerobes, wherein the process comprises use of an enzyme of the invention or a method of the invention. This biofuel, e.g., a biogas, can be produced either from biodegradable waste materials or by the use of energy crops fed into anaerobic digesters to supplement gas yields. The solid output, digestate, can also be used as a biofuel.

The invention provides methods for making biologically produced oils, including crude oils, and gases that can be used in diesel engines, wherein the process comprises use of an enzyme of the invention or a method of the invention. In one aspect, these methods can refine petroleum, e.g., crude oils, into kerosene, petroleum, diesel and other fractions.

The invention provides methods (using an enzyme of the invention or a method of the invention) for making biologically produced oils from:
Straight vegetable oil (SVO).
Waste vegetable oil (WVO)—waste cooking oils and greases produced in quantity mostly by commercial kitchens.
Biodiesel obtained from transesterification of animal fats and vegetable oil, directly usable in petroleum diesel engines.
Biologically derived crude oil, together with biogas and carbon solids via the thermal depolymerization of complex organic materials including non oil based materials; for example, waste products such as old tires, offal, wood and plastic.
Pyrolysis oil; which may be produced out of biomass, wood waste etc. using heat only in the flash pyrolysis process (the oil may have to be treated before using in conventional fuel systems or internal combustion engines).
Wood, charcoal, and dried dung.

The invention will be further described with reference to the following examples; however, it is to be understood that the invention is not limited to such examples.

EXAMPLES

The Examples in Part A describe the methodologies used for initial characterization of the candidate isomerase and epimerase nucleic acids and the encoded polypeptides. Further characterization of the isomerase and epimerase nucleic acids and polypeptides is described in Part B.

Part A

Example 1

Effect of Leader Sequence on Racemase

Many of the racemases that were discovered had native signal/leader sequences. The signal sequences and corresponding cleavage sites were identified by SignalP 3.0 (at cbs.dtu.dk/services/SignalP/on the World Wide Web). It was observed that clones containing racemases with leader sequences tended to be more difficult to grow. The clones grew well with fresh transformations, however they did not grow well when they were subcultured or inoculated from glycerol stocks. Samples were grown (or, at least, attempted) a minimum of two times.

The table below indicates several clones that contained their native signal sequences. These samples were in the PCR4-TOPO vector/E. coli Top10 host (Invitrogen, Carlsbad, Calif.). Growth conditions were over-night in LB/kanamycin 50 µg/mL, 37° C. All of these samples were difficult to grow. The consensus leader sequence for the samples shown below is: MHKKTLLATLIFGLLAGQAVA (SEQ ID NO:499). 19 of the clones have this leader sequence exactly. 17 of the clones have a leader sequence that differs by one amino acid: MHKKTLLATLILGLLAGQAVA (SEQ ID NO:500). Therefore, the consensus sequence for racemase leader sequences is MHKKTLLATLIXGLLAGQAVA (SEQ ID NO:501) where X is F or L.

TABLE 4

| Leadered racemase clones | | | |
|---|---|---|---|
| Clone | Clone | Clone | Clone |
| SEQ ID NO: 170 | SEQ ID NO: 180 | SEQ ID NO: 134 | SEQ ID NO: 118 |
| SEQ ID NO: 108 | SEQ ID NO: 182 | SEQ ID NO: 146 | SEQ ID NO: 194 |
| SEQ ID NO: 172 | SEQ ID NO: 184 | SEQ ID NO: 112 | SEQ ID NO: 154 |
| SEQ ID NO: 136 | SEQ ID NO: 140 | SEQ ID NO: 114 | SEQ ID NO: 156 |
| SEQ ID NO: 110 | SEQ ID NO: 142 | SEQ ID NO: 148 | SEQ ID NO: 196 |
| SEQ ID NO: 174 | SEQ ID NO: 186 | SEQ ID NO: 116 | SEQ ID NO: 158 |
| SEQ ID NO: 138 | SEQ ID NO: 144 | SEQ ID NO: 150 | SEQ ID NO: 120 |
| SEQ ID NO: 176 | SEQ ID NO: 188 | SEQ ID NO: 192 | SEQ ID NO: 160 |

TABLE 4-continued

Leadered racemase clones

| Clone | Clone | Clone | Clone |
|---|---|---|---|
| SEQ ID NO: 178 | SEQ ID NO: 190 | SEQ ID NO: 152 | SEQ ID NO: 162 |

The leadered racemase clone (*Pseudomonas putida* KT2440 BAR—that was not difficult to grow. The leadered racemase clone (*Pseudomonas putida* KT2440 BAR was in the pET30 vector (Novagen, Madison, Wis.)/*E. coli* expression host BL21(DE3) (Novagen, Madison, Wis.). The leader sequence for the *Pseudomonas putida* KT2440 BAR was determined to be: MPFRRTLLAASLALLITGQAPLYA (SEQ ID NO:502).

To further investigate the effect of the leader sequence on growth, some racemases were subcloned into expression vectors with and without the native signal sequences. The samples are listed below (Table 5). The left-hand column indicates the leadered subclone version while the middle column indicates the same gene subcloned without a leader sequence (for example, SEQ ID NO:412 is the leaderless version of SEQ ID NO:490). These samples were in the pSE420-cHis vector/*E. coli* MB2946 host (Strych & Benedik, 2002, *J. Bacteriology*, 184:4321-5). The his-tag was not expressed in these constructs. Growth conditions were overnight in LB/carbenicillin 100 μg/mL, 37° C.

TABLE 5

Racemases that were subcloned with and without the native leader sequence

| Subclone w/ native leader | Subclone counterpart w/out leader | Comments |
|---|---|---|
| SEQ ID NO: 490 | SEQ ID NO: 412 | leadered version difficult to grow |
| SEQ ID NO: 492 | SEQ ID NO: 400 | no difficulties growing either version |
| SEQ ID NO: 494 | SEQ ID NO: 408 | leadered version difficult to grow |
| SEQ ID NO: 496 | SEQ ID NO: 410 | leadered version difficult to grow |
| SEQ ID NO: 498 | SEQ ID NO: 402 | leadered version difficult to grow |
| SEQ ID NO: 428 | SEQ ID NO: 404 | leadered version does not reach OD600 = 0.5 within 8 hours; could not induce |
| SEQ ID NO: 430 | SEQ ID NO: 406 | leadered version does not reach OD600 = 0.5 within 8 hours; could not induce |

In general, the leadered racemase subclones were more difficult to grow than the non-leadered counterparts under the conditions described in Part A. SEQ ID NO:490, SEQ ID NO:494, SEQ ID NO:496 and SEQ ID NO:498 were difficult to grow. SEQ ID NO:428 and SEQ ID NO:430 would grow however they grew extremely slowly and did not reach an inducible $OD_{600}$=0.5 within 8 hours. SEQ ID NO:492 was the only leadered racemase subclone tested that was not difficult to grow.

In summary, leadered racemase candidates generally were harder to grow than the non-leadered counterparts under the conditions described above. The reason for the decrease in viability or robustness has not been identified. The cells could potentially be expelling the plasmids, thereby losing the antibiotic resistance over time. In order to maximize robustness, the number of rounds of growth for racemases with leader sequences was minimized. This was done by storing the DNA and performing fresh transformations each time the constructs were used.

The host organisms, expression conditions, and post expression cell handling can all affect whether there is detectable tryptophan racemase activity under the conditions of the assay in the presence of the respective leader sequences. Additionally, under optimized conditions, it is expected that all racemase candidates could have tryptophan racemase activity with or without leader sequences (native or artificial such as PelB).

Example 2

Improvement of SEQ ID NO:412 Solubility using ARCTICEXPRESS™ Hosts

The expression of SEQ ID NO:412 racemase was analyzed by SDS-PAGE. SEQ ID NO:412 expressed well and had high activity even though only a portion (<20%) of the protein was soluble. In order to improve soluble expression, the racemase was moved into two ARCTICEXPRESS™ hosts (Stratagene, La Jolla, Calif.). The racemase was subcloned into the pET28b vector and the DNA was transformed into ArcticExpress™ (DE3) and ArcticExpress™ (DE3)RIL and plated on LB kanamycin 50 μg/mL, gentamicin 20 μg/mL, and LB kanamycin 50 μg/mL, gentamicin 20 μg/mL, streptomycin 75 μg/mL, respectively. pET28b vector control DNA was also transformed into each host. Samples were grown overnight at 30° C. Four colonies were picked for each construct from each ArcticExpress™ host.

TABLE 6

Names of constructs in ArcticExpress ™(DE3) & ArcticExpress ™(DE3)RIL

| Name | Description |
|---|---|
| DE3-1 | SEQ ID NO: 412 racemase ORF in pET28b/ArcticExpress ™(DE3)-colony #1 |
| DE3-2 | SEQ ID NO: 412 racemase ORF in pET28b/ArcticExpress ™(DE3)-colony #2 |
| DE3-3 | SEQ ID NO: 412 racemase ORF in pET28b/ArcticExpress ™(DE3)-colony #3 |
| DE3-4 | SEQ ID NO: 412 racemase ORF in pET28b/ArcticExpress ™(DE3)-colony #4 |
| DE3-V | pET28b/ArcticExpress ™(DE3) |
| RIL-1 | SEQ ID NO: 412 racemase ORF in pET28b/ArcticExpress ™(DE3)RIL-colony #1 |
| RIL-2 | SEQ ID NO: 412 racemase ORF in pET28b/ArcticExpress ™(DE3)RIL-colony #2 |

TABLE 6-continued

Names of constructs in ArcticExpress ™(DE3) & ArcticExpress ™(DE3)RIL

| Name | Description |
| --- | --- |
| RIL-3 | SEQ ID NO: 412 racemase ORF in pET28b/ArcticExpress ™(DE3)RIL-colony #3 |
| RIL-3 | SEQ ID NO: 412 racemase ORF in pET28b/ArcticExpress ™(DE3)RIL-colony #4 |
| RIL-V | pET28b/ArcticExpress ™(DE3)RIL |

Cultures were streaked onto fresh plates with the appropriate antibiotics, two days prior to performing a large scale growth. Samples were grown on LB plates with the appropriate antibiotics and incubated overnight at 30° C. The next day, a single colony was picked from each plate and used to inoculate 50 mL of LB with appropriate antibiotics. Samples were incubated overnight at 30° C. and 210 rpm. The next day, the culture was used to inoculate 500 mLs of LB with the appropriate antibiotics in a 2.8 L baffled flask to $OD_{600}$=0.05. The cultures were grown at 30° C. at 210 rpm. When the $OD_{600}$ was between 0.4-0.8, the flasks were transferred to an 11° C. incubator and allowed to incubate for 10 minutes prior to inducing with 1 mM IPTG Samples were induced overnight at 11° C. at 210 rpm (with the exception of DE3-2 and DE3-4, which were induced at 16° C.).

The next morning the cultures were collected and centrifuged at 6,000 rpm for 20 minutes, and the supernatant was discarded. The pellet was resuspended in 20 mL of 50 mM sodium phosphate buffer (pH 7.5), 400 µg/mL lysozyme, 26 U/mL DNase I. Cells were lysed using a microfluidizer (Microfluidics Corporation, Newton, Mass.) per the manufacturer's instructions; each sample was passed through the microfluidizer three times. 1 mL of lysate was set aside for gel analysis of the total protein fraction. The remainder of the lysate was centrifuged at 12,000 rpm at 4° C. for 30 minutes. The supernatant was saved. Protein concentration was determined using the Bio-Rad Protein Assay (Bio-Rad, Hercules, Calif.). The soluble and whole cell fraction was then analyzed by SDS-PAGE using 4-20% Tris-glycine gels (Invitrogen, Carlsbad, Calif.).

TABLE 7

Soluble expression levels of racemase constructs in pET28b/ArcticExpress ™(DE3) and pET28b/ArcticExpress ™(DE3)RIL

| Name | Soluble Expression |
| --- | --- |
| DE3-1 | <75% |
| DE3-2 | <75% |
| DE3-3 | <75% |
| DE3-4 | <75% |
| RIL-1 | <75% |
| RIL-2 | <50% |
| RIL-3 | <75% |
| RIL-4 | <50% |

As shown above, the soluble expression of the racemase was improved in the ArcticExpress™ (DE3) & ArcticExpress™ (DE3)RIL host.

Samples were tested for activity using a racemase assay (as described in Example 4). Racemases were loaded at 7.5, 0.75, 0.075 µg/mL total protein and incubated with 10 mM L-tryptophan and 10 µM PLP at pH 8 and 37° C. At indicated timepoints, 50 µL of the reaction product was added to 150 µl of ice cold acetonitrile. Samples were vortexed for 30 seconds and the supernatant was then diluted fifty-fold in methanol. Samples were then analyzed by LC/MS/MS (as described in Example 4) to monitor the D-tryptophan formed and the residual L-tryptophan.

TABLE 8

Racemase activity of SEQ ID NO: 412 constructs in ArcticExpress(DE3) and ArcticExpress(DE3)RIL

| | µg/ml D-tryptophan formed | | | |
| --- | --- | --- | --- | --- |
| Name | 0 hrs | 1.75 hrs | 3.75 hrs | 19.75 hrs |
| DE3-1 | 13.58 | 1010 | 1488 | 1278 |
| DE3-2 | 4.24 | 1044 | 1130 | 1044 |
| DE3-3 | 4 | 1018 | 1180 | 1166 |
| DE3-4 | 5.46 | 1060 | 1070 | 1112 |
| RIL-1 | 14.2 | 1128 | 1178 | 1564 |
| RIL-2 | 13.2 | 976 | 1078 | 1110 |
| RIL-3 | 10.2 | 954 | 1122 | 1134 |
| RIL-4 | 7.98 | 1008 | 1164 | 1134 |

7.5 µg/mL total protein

As shown above, all of the constructs were active in ArcticExpress(DE3) & ArcticExpress(DE3)RIL at a 7.5 µg/mL total protein load. All the constructs were also active when the protein was loading at 0.75 and 0.075 µg/mL total protein. The vector/host controls had little or no activity compared to the racemase constructs.

In summary, the SEQ ID NO:412 racemase was active and soluble expression was improved in ArcticExpress™ (DE3) & ArcticExpress™ (DE3)RIL.

Example 3

Activity of Racemase PFAM Domain Subclones

Several sets of proprietary degenerate PCR primers were designed as part of a sequence-based discovery effort for the amplification of racemases from mixed population environmental DNA libraries as described in U.S. Pat. No. 6,455,254. One set of proprietary degenerate PCR primers amplified the PFAM domain of the racemase exclusively. The racemases were amplified using a sequence-based discovery method (see U.S. Pat. No. 6,455,254). The PFAM domain is slightly smaller than the full-length racemase protein. As compared to the full length racemase, the PFAM domain is missing about 30-40 amino acids from the N-terminus (mostly signal peptide) and about 10-20 amino acids from the C-terminus.

Several racemase PFAM domains were amplified using this method. Three PFAM domains were selected for subcloning in order to determine if the PFAM domain was sufficient to detect racemase activity. The samples were subcloned into the pSE420-cHis vector (his-tag not expressed) in *E. coli* MB2946 host cells (Strych & Benedik, 2002, *J. Bac-* teriology, 184:4321-5). The subclones were SEQ ID NO:122, SEQ ID NO:440 and SEQ ID NO:462.

SEQ ID NO:122 was selected for activity testing. Flasks containing 50 mL LB, 100 µg/mL carbenicillin and 50 mM D-alanine were inoculated from glycerol stocks and grown overnight at 37° C. with shaking. The following morning, flasks containing 400 mL LB, 100 µg/mL carbenicillin and 50 mM D-alanine were inoculated to $OD_{600}$=0.05. Cultures were grown at 37° C. with shaking and induced with 1 mM IPTG when $OD_{600}$=0.5-0.8. Cultures were induced overnight at 30° C.

Cell pellets were collected by centrifugation at 6000 rpm for 20 minutes. Cell pellets were resuspended in 20 mL of 50 mM sodium phosphate buffer pH 7.5 with 26 U/ml DNase I. Cell pellets were lysed in a microfluidizer (Microfluidics Corporation, Newton, Mass.) per the manufacturer's instructions. Samples were centrifuged at 12,000 rpm for 30 minutes and the soluble fraction was collected. Protein concentration was determined by comparing the absorbance of SEQ ID NO:122 cell extract to known standards in the Bio-Rad Protein Assay reagent (Bio-Rad, Hercules, Calif.).

Samples were tested for activity using the following racemase assay conditions (also as described in Example 4). Racemases were loaded at 10 mg/mL total protein and incubated with 10 mM L-tryptophan and 10 µM PLP at pH 8 and a temperature of 37° C. At indicated timepoints (0, 2, 4, and 24 hours), 50 µL of the reaction product was added to 150 µL of ice-cold acetonitrile. Samples were vortexed for 30 seconds and passed through a 0.2 µm filter and the filtrate was then diluted fifty-fold in methanol. Samples were then analyzed by LC/MS/MS (as described in Example 4) to monitor the D-tryptophan formed (Table 9).

TABLE 9

Racemase activity of PFAM

| Name | Description | µg/ml D-tryptophan | | | |
|---|---|---|---|---|---|
| | | 0 hr | 2 hr | 4 hr | 24 hr |
| E. coli MB2946 host cells | Negative control | 0.26 | 0.18 | 0.22 | 0.22 |
| Pseudomonas putida KT2440 BAR (leadered) | Positive control | 0.23 | 58.97 | 88.35 | 180.41 |
| SEQ ID NO: 122 | Racemase PFAM | 0.67 | 33.84 | 58.18 | 106.69 |
| No enzyme | | 0.18 | 0.21 | 0.21 | 0.18 |

Negative control—*E. coli* MB2946 host cells (Strych & Benedik, supra)

The leadered racemase clone (*Pseudomonas putida* KT2440 BAR—SEQ ID NO:122 was active under the conditions described in Example 4. The results above thereby demonstrate that a racemase PFAM domain could be sufficient to detect racemase activity.

Example 4

Growth and Racemase Assay Procedures

Enzyme Preparation

Glycerol stocks were used to inoculate flasks containing 50 mLs of LB with the appropriate antibiotic. The starter culture was grown overnight at 37° C. and 230 rpm. The $OD_{600\,nm}$ of starter culture was checked, and used to inoculate a 400 ml culture to an $OD_{600\,nm}$ of 0.05. The culture was incubated at 37° C. and 230 rpm, and the $OD_{600\,nm}$ was checked periodically. The cultures were induced, usually with 1 mM IPTG, when the $OD_{600\,nm}$ reached between 0.5-0.8. Induced cultures were incubated overnight at 30° C. and 230 rpm. The culture was harvested by pelleting cells at 4000 rpm for 15 minutes. The supernatant was poured off, and either frozen for later use or the cells lysed.

The pellets were resuspended in 20 mls of 50 mM sodium phosphate buffer (pH 7.5) supplemented with 26 U/ml of DNase. Once the pellet was completely resuspended in the buffer, cells were lysed using a microfluidizer (Microfluidics Corporation, Newton, Mass.) per the manufacturer's instructions. The clarified lysate was collected and centrifuged at 11,000 rpm for 30 minutes. The supernatant was collected in a clean tube and filtered through a 0.2 µm filter. 5 mls aliquots of clarified lysate were placed in each vial and freeze-dried using the lyophilizer (Virtis Company, Gardinier, N.Y.) per the manufacturer's instructions. A 1 ml sample was retained for protein estimation using the Bio-Rad Protein Assay Reagent (Bio-Rad, Hercules, Calif.) and SDS-PAGE analysis. Once the lysate was lyophilized, the amount of protein per vial was calculated.

Enzymes were prepared for the activity assay by resuspending in 50 mM sodium phosphate (pH 7.5). The racemase assays were usually run with about 10-20 mg/ml total protein.

Racemase Assay 10 mM L-tryptophan, 10 µM PLP, 50 mM sodium phosphate pH 8, 10 mg/mL racemase (total protein) prepared as described above (see Example 4—Enzyme Preparation) were combined and incubated at 37° C. and 300 rpm. 50 µL, of the reaction product were transferred to 1500, of ice cold acetonitrile at timepoints (generally 0, 2, 4, and 24 hours) and the samples were vortexed for 30 seconds. The samples were centrifuged at 13,200 rpm for 10 minutes and 4° C. and the supernatant was passed through a 0.45 µm filter. The filtrate was diluted 10-fold in methanol. Samples were analyzed by LC/MS/MS to monitor the D-tryptophan formed (see description below).

LC/MS/MS Method for Detecting D- and L-Tryptophan

LC/MS/MS screening was achieved by injecting samples from 96-well plates using a CTCPal auto-sampler (LEAP Technologies, Carrboro, N.C.) into a 70/30 MeOH/$H_2O$ (0.25% AcOH) mixture provided by LC-10ADvp pumps (Shimadzu, Kyoto, Japan) at 0.8 mL/min through a Chirobiotic T column (4.6×250 mm) and into the API4000 TurboIonSpray triple-quad mass spectrometer (Applied Biosystems, Foster City, Calif.). Ion spray and Multiple Reaction Monitoring (MRM) were performed for the analytes of interest in the positive ion mode and each analysis lasted 15.0 minutes. D- and L-tryptophan parent/daughter ions: 205.16/188.20.

Example 5

Racemase Activity Dependent Upon Conditions

SEQ ID NO:402, SEQ ID NO:386, SEQ ID NO:396, SEQ ID NO:414, SEQ ID NO:420, SEQ ID NO:422, SEQ ID NO:122*, SEQ ID NO:438, SEQ ID NO:428**, SEQ ID NO:434, & SEQ ID NO:436 are racemase subclones that were active under the conditions described in Part A. These subclones were not active under the conditions described in Part B (see Example 6 for details for details on SEQ ID NO:386, SEQ ID NO:396, SEQ ID NO:402; see Example 7 for details on SEQ ID NO:414; see Example 12 for details on SEQ ID NO:420, SEQ ID NO:422, SEQ ID NO:122, SEQ ID NO:428, SEQ ID NO:434, SEQ ID NO:436, SEQ ID NO:438).

The racemase subclones were in the pSE420-C-His vector/ E. coli MB2946 host (Strych & Benedik, 2002, J. Bacteriology, 184:4321-5) with the exception of SEQ ID NO:414. SEQ ID NO:414 was in pse420-c-His/E. coli Top10 host (Invitrogen, Carlsbad, Calif.). The his-tag was not expressed in any of these subclones.

The subclones were grown, lysed and lyophilized according to the procedures described in Example 4. Samples were tested for activity using a racemase assay (as described in Example 4). Racemases were incubated with 10 mM L-tryptophan and 10 µM PLP at pH 8 and 37° C. All racemases were loaded at 10 mg/mL total protein with the exception of SEQ ID NO:402. SEQ ID NO:402 was loaded at 5 mg/mL total protein because there was not enough biomass to allow for a higher loading.

At indicated timepoints, 504 of the reaction product was added to 150 µL of ice cold acetonitrile. Samples were vortexed for 30 seconds and the supernatant was then diluted fifty-fold in methanol. Samples were then analyzed by LC/MS/MS (as described in Example 4) to monitor the D-tryptophan formed and the residual L-tryptophan remaining.

Tables 10, 11, 12, and 13 show the racemase activity over time. Samples that were assayed together are grouped together in a single table.

TABLE 10

Racemase activity assay for SEQ ID NO: 414, SEQ ID NO: 420, SEQ ID NO: 422, SEQ ID NO: 434, and SEQ ID NO: 436, SEQ ID NO: 438

| | µg/ml D-tryptophan formed | | | | | | | | |
|---|---|---|---|---|---|---|---|---|---|
| Time (hours) | SEQ ID NO: 414 | SEQ ID NO: 420 | SEQ ID NO: 422 | SEQ ID NO: 434 | SEQ ID NO: 436 | SEQ ID NO: 438 | No enzyme | (−) control | (+) control |
| 0 | 0.19 | 0.96 | 0.96 | 0.20 | 0.18 | 22.35 | 0.18 | 0.26 | 0.23 |
| 2 | 33.23 | 309.78 | 187.81 | 1.63 | 0.21 | 38.70 | 0.21 | 0.18 | 58.97 |
| 4 | 51.87 | 320.22 | 191.46 | 2.92 | 2.85 | 71.35 | 0.21 | 0.22 | 88.35 |
| 24 | 119.45 | 344.74 | 128.80 | 8.01 | 4.19 | 101.03 | 0.18 | 0.22 | 180.42 |

TABLE 11

Racemase activity assay for SEQ ID NO: 402

| | µg/ml D-tryptophan formed | | |
|---|---|---|---|
| Time (hours) | SEQ ID NO: 402 | (−) control | (+) control |
| 0 | 0.00 | 1.85 | 8.29 |
| 2 | 19.67 | 0.00 | 583.79 |
| 4 | 18.25 | 0.00 | 715.26 |
| 24 | 44.05 | 4.32 | 730.14 |

TABLE 12

Racemase activity assay for SEQ ID NO: 396

| | µg/ml D-tryptophan formed | | |
|---|---|---|---|
| Time (hours) | SEQ ID NO: 396 | (−) control | (+) control |
| 0 | 3.51 | 0.00 | 0.00 |
| 2 | 10.58 | 0.00 | 189.04 |
| 4 | 12.29 | 0.00 | 231.84 |
| 24 | 63.49 | 0.63 | 609.44 |

TABLE 13

Racemase activity assay for SEQ ID NO: 386

| | µg/ml D-tryptophan formed | | |
|---|---|---|---|
| Time (hours) | SEQ ID NO: 386 | (−) control | (+) control |
| 0 | 0.00 | 0.00 | 0.80 |
| 2 | 0.00 | 0.00 | 189.04 |
| 4 | 6.03 | 0.00 | 230.98 |
| 24 | 5.23 | 3.10 | 478.75 |

In summary, SEQ ID NO:402, SEQ ID NO:386, SEQ ID NO:396, SEQ ID NO:414, SEQ ID NO:420, SEQ ID NO:422, SEQ ID NO:122*, SEQ ID NO:438, SEQ ID NO:434, and SEQ ID NO:436 were active on tryptophan under the conditions described in Part A. These samples were not active under the conditions described in Part B (see Examples 6, 7, and 12). The differences in observed racemase activity may be attributed to differences in host strains, expression conditions, post-expression cell handling and assay protein-loading. Refer to Example 3 for SEQ ID NO:122 activity data. It is noted that SEQ ID NO:428 is not included here because it did not reach an inducible $OD_{600}$ and, therefore, was not induced.

It is expected that the presence of activity in a polypeptide encoded from a subcloned nucleic acid is predictive of the presence of activity in the corresponding polypeptide encoded from the full-length or wild type nucleic acid.

TABLE 14

| Sub-clone number | Wild-Type Clone |
|---|---|
| SEQ ID NO: 402 | SEQ ID NO: 52 |
| SEQ ID NO: 386 | SEQ ID NO: 36 |
| SEQ ID NO: 396 | SEQ ID NO: 10 |
| SEQ ID NO: 414 | SEQ ID NO: 8 |
| SEQ ID NO: 420 | SEQ ID NO: 116 |
| SEQ ID NO: 422 | SEQ ID NO: 118 |
| SEQ ID NO: 122 | SEQ ID NO: 122 |
| SEQ ID NO: 438 | SEQ ID NO: 104 |
| SEQ ID NO: 434 | SEQ ID NO: 56 |
| SEQ ID NO: 436 | SEQ ID NO: 114 |

Part B

Example 6

Analysis of Racemases Provided as pSE420 Clones

SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID

NO:404, SEQ ID NO:406, SEQ ID NO:408, and SEQ ID NO:410 racemases were provided as pSE420 clones. One skilled in the art can synthesize the genes encoding these racemases using various published techniques for example, as described in Stemmer et al., 1995, *Gene*, 164(1):49-53. The plasmids were transformed into *E. coli* XL-1 Blue (Novagen/EMD Biosciences, San Diego, Calif.) cells as per manufacturer instructions.

Transformants were grown overnight at 37° C. and 250 rpm in 5 ml LB containing ampicillin (100 µg/mL). Overnight cultures were used to inoculate 25 mL of the same media in 250 mL baffled shake flasks. Cultures were grown at 30° C. and 250 rpm until they reached an $OD_{600}$ of 0.6, after which protein expression was induced with 1 mM IPTG for 4.25 h at 30° C. Samples for total protein were taken prior to induction and right before harvesting. Cells were harvested by centrifugation and frozen at −80° C.

TABLE 15

D-trp Production

| Racemase Candidate | µg/mL D-trp 2 hours | µg/mL D-trp 21 hours |
|---|---|---|
| pSE420 vector control | nd | nd |
| SEQ ID NO: 386 | nd | nd |
| SEQ ID NO: 388 | nd | nd |
| SEQ ID NO: 390 | nd | nd |
| SEQ ID NO: 392 | nd | nd |
| SEQ ID NO: 394 | nd | 6 |
| SEQ ID NO: 396 | nd | nd |
| SEQ ID NO: 398 | nd | nd |
| SEQ ID NO: 414 | nd | nd |
| SEQ ID NO: 400 | 46 | 410 |
| SEQ ID NO: 402 | nd | nd |
| SEQ ID NO: 404 | 10 | 18 |
| SEQ ID NO: 406 | 1171 | 2724 |
| SEQ ID NO: 408 | 248 | 785 |
| SEQ ID NO: 410 | 502 | 1435 |
| *A. caviae* wild-type BAR | 1695 | 3820 | nd = not detected under the conditions of the assay as described above

It is noted that, when cell-free extracts were used, very low expression was observed. It was concluded, therefore, that the cell-free extracts likely contained significantly less protein than the purified positive control enzyme (wild-type *A. caviae*)

Tryptophan racemase activity was detected for SEQ ID NO:400, SEQ ID NO:404, SEQ ID NO:406, SEQ ID NO:408 and SEQ ID NO:410 using the conditions described in Part B. Similar results were obtained for SEQ ID NO:400, SEQ ID NO:404, SEQ ID NO:406, SEQ ID NO:408 and SEQ ID NO:410 using the reaction conditions described in Part A. In addition, detectable activity was observed for candidates SEQ ID NO:386, SEQ ID NO:396, and SEQ ID NO:402 using conditions described in Part A, but was not observed using conditions described in Part B (see, for example, Example 5). Detectable activity was not observed for SEQ ID NO:394 under the conditions described in Part A, while very low activity (barely detectable at 21 hours) was observed for SEQ ID NO:394 under the conditions described in Part B.

Some constructs were observed, under the conditions described in Part A, to be unstable in expression systems, particularly those with a leader sequence. The host organisms, expression conditions, and post expression cell handling can all affect whether there is detectable tryptophan racemase activity under the conditions of the assay. Additionally, under optimized conditions, it is expected that all racemase candidates could have tryptophan racemase activity.

The presence of activity in a polypeptide encoded from a subcloned nucleic acid is predictive of (also demonstrates) the presence of activity in the corresponding polypeptide encoded from the full-length or wild type nucleic acid.

TABLE 16

| Sub-clone number | Wild-Type Clone |
|---|---|
| SEQ ID NO: 400 | SEQ ID NO: 42 |
| SEQ ID NO: 404 | SEQ ID NO: 54 |
| SEQ ID NO: 406 | SEQ ID NO: 58 |
| SEQ ID NO: 408 | SEQ ID NO: 48 |
| SEQ ID NO: 410 | SEQ ID NO: 46 |
| SEQ ID NO: 394 | SEQ ID NO: 4 |

Example 7

Characterization of Racemase SEQ ID NO:414 and Racemase SEQ ID NO:412

SEQ ID NO:412 and SEQ ID NO:414 were both found to be active when assayed for tryptophan racemase activity under the conditions described in Part A. One skilled in the art can synthesize the genes encoding these racemases using various published techniques for example, as described in Stemmer et al., supra. It should be noted that 10 mg of total protein in the form of lyophilized cell extracts was used in Part A when evaluating racemase activity (see Example 4). In some cases, this was ten times as much total soluble protein as was used in the assays described in Part B. This differences in the amount of protein used in the assays (i.e., of Part A vs. Part B) may explain, at least in part, some of the differences in activity observed with the same polypeptide.

SEQ ID NO:414 was expressed in 3 different hosts in Part A (MB2946, XL-1 Blue, and TOP10). High activity was observed in cell-free extract from the TOP10 host, with only a small amount of activity observed in XL-1 Blue and no detectable product formed from the MB2946 host under the conditions of the assay. SEQ ID NO:412 was expressed in the MB2946 host and found to be highly active.

SEQ ID NO:412 and SEQ ID NO:414 were received as pSE420 constructs, which were initially evaluated in *E. coli* TOP10. Strains were grown and induced, and cell extracts were prepared as described in Part B.

Tryptophan racemase assays were carried out using desalted cell-free extracts under the conditions described in Example 17.

Purified *A. caviae* D76N (100 µg) served as a positive control for the assay, and cell-free extract of *E. coli* host cells containing the empty vector pSE420 served as a negative control. 1.4 mg of total protein was used for SEQ ID NO:412 and SEQ ID NO:414.

TABLE 17

Trp Assay results

| | D-trp production, µg/mL | | | |
|---|---|---|---|---|
| Time (Hr) | pSE420 (vector control) | *A. caviae* D76N | SEQ ID NO: 414 | SEQ ID NO: 412 |
| 0 | nd | nd | nd | nd |
| 0.5 | 9 | 1797 | nd | 1205 |
| 1 | 12 | 3764 | nd | 1765 |

TABLE 17-continued

Trp Assay results

D-trp production, µg/mL

| Time (Hr) | pSE420 (vector control) | A. caviae D76N | SEQ ID NO: 414 | SEQ ID NO: 412 |
|---|---|---|---|---|
| 4 | 24 | 3818 | 2 | 3012 |
| 22 | 22 | 3621 | 33 | 2204 | nd = not detected under the conditions of the assay as described above control was purified BAR from A. caviae D76N mutant - 100 µg/ml not much activity detected in crude extract from SEQ ID NO: 414 (1.4 mg/ml) some limited (very low) activity in extracts containing pSE420 vector control considering that no band was observed in crude extracts from SEQ ID NO: 412, good activity.

There was very little activity detected in crude extract from SEQ ID NO:414 as well as negative control. SEQ ID NO:412 gave high specific activity given that there was barely detectable protein band observed in the soluble fraction (comparing 100 µg of purified A. caviae BAR to an estimated less than 30 µg of SEQ ID NO:412, assuming it was 2% or less of the total protein).

The host organisms, expression conditions, and post expression cell handling can all affect whether there is detectable tryptophan racemase activity under the conditions of the assay. Additionally, under optimized conditions, it is expected that all racemase candidates could have tryptophan racemase activity.

It is expected that the presence of activity in a polypeptide encoded from a subcloned nucleic acid is predictive of the presence of activity in the corresponding polypeptide encoded from the full-length or wild type nucleic acid.

TABLE 18

| Sub-clone number | Wild-Type Clone |
|---|---|
| SEQ ID NO: 414 | SEQ ID NO: 8 |
| SEQ ID NO: 412 | SEQ ID NO: 62 |

Example 8

SEQ ID NO:412 is More Active on Tryptophan than Alanine

In order to get a more quantitative comparison of SEQ ID NO:412 to the benchmark BAR (A. caviae D76N), SEQ ID NO:412 was PCR-amplified with NcoI and Xho I restriction sites for subcloning into pET28 (Novagen/EMD Chemicals, San Diego, Calif.).

| Designation | Sequence | SEQ ID NO: |
|---|---|---|
| SEQ ID NO: 412 F NcoI | GGTTCCGGAACCATGGCCGAAACAAATCTGC | 503 |
| SEQ ID NO: 412 R XhoI with stop | GGTTCCAAGGCTCGAGCTATTTTGTTCTGCTAT TCTATATGTC | 504 |
| SEQ ID NO: 412 R XhoI | GGTTCCAAGGCTCGAGTTTTGTTCTGCTATTCTA TATGTC | 505 | pET28 constructs were created with and without a C-terminal His tag (tagged constructs were created by using a reverse primer without a stop codon in the PCR). pET26b constructs were created with a C-terminal His tag. Constructs were sequenced for accuracy (Agencourt Bioscience Inc., Beverly Mass.) and used to transform E. coli BL21(DE3) (Novagen/EMD Biosciences, San Diego, Calif.).

Transformants were grown and induced in OvernightExpress™ media and cell-free extracts were prepared as described herein. Proteins were purified from tagged constructs on Novagen/EMD Biosciences His-bind columns (Novagen/EMD Biosciences, San Diego, Calif.) and desalted on PD-10 columns; for untagged constructs, cell-free extracts were desalted on PD-10 columns.

Protein concentrations were determined by Pierce BCA protein assay and racemase purity was determined by Experion Automated Gel System (Experion, version A.01.10, Biorad, Hercules, Calif.). Racemase assays were performed on purified and crude protein extracts as described in Example 17. Racemase expression in the pET26b construct was lower than the pET28 vector, however active SEQ ID NO:412 protein was obtained. Results for SEQ ID NO:412/pET28 are shown in this example.

D-trp production (µg/mL) in SEQ ID NO: 412 (NOT normalized)

| Time (Hr) | A. caviae D76N (100 µg) | SEQ ID NO: 412/pET28 CFE (100 µg) | SEQ ID NO: 412/pET28 purified (30 µg) |
|---|---|---|---|
| 0 | nd | nd | 70 |
| 0.5 | 1114 | 465 | 3133 |
| 1 | 3487 | 791 | 3350 |
| 2 | 4029 | 1113 | 4485 |

*Note 30 µg of SEQ ID NO: 412/pET28 purified protein was used as compared to 100 µg of other enzyme preps.
nd = not detected under the conditions of the assay as described above Purified SEQ ID NO:412 protein from construct in pET28 was further characterized for racemase activity on tryptophan, alanine, and monatin. Tryptophan, monatin, and alanine assays were performed as described in Example 17, with A. caviae D76N serving as positive control for racemization assays.

SEQ ID NO:412 Racemase Prefers Tryptophan as a Substrate

D-Trp nmoles/µl/µg Protein

| Time (min) | A. caviae D76N | SEQ ID NO: 412/pET28 purified |
|---|---|---|
| 0 | nd | nd |
| 5 | 59 | 353 |
| 10 | 123 | 500 |
| 20 | 128 | 715 |
| 60 | 305 | 2145 |

D-Ala nmoles/µl/µg Protein

| Time (min) | A. caviae D76N | SEQ ID NO: 412/pET28 purified |
|---|---|---|
| 0 | 44 | nd |
| 5 | 1320 | nd |

-continued

| Time (min) | A. caviae D76N | SEQ ID NO: 412/pET28 purified |
|---|---|---|
| 10 | 2239 | 23 |
| 20 | 2602 | 314 |
| 60 | 4654 | 1044 | nd = not detected under the conditions of the assay as described above

SEQ ID NO:412 consistently gave higher D-trp activity than the control racemase candidate, BAR, *A. caviae* D76N. SEQ ID NO:412 appears to be specific for tryptophan versus alanine as a substrate for racemization. In contrast, *A. caviae* D76N BAR while active on tryptophan, has a preference for alanine as a substrate. The ability of purified SEQ ID NO:412 to racemize 7 additional L-amino acids was evaluated and the details are reported in Example 10.

In addition, the impact of alanine on tryptophan racemase activity was investigated. An experiment was designed to determine the impact of L-alanine on the racemization of L-tryptophan by either BAR *A. caviae* D76N or racemase candidate SEQ ID NO:412. Racemase enzymes were assayed in the presence of tryptophan and alanine together to further characterize substrate preference/competition. Assay was carried out as described in Example 17, with 30 mM of each substrate (L-Trp and L-Ala) in the reaction. For both racemase enzymes, control racemase assays were conducted in the presence of L-tryptophan alone. The data from these control assays at various time points were considered to be 100% when compared with the respective data from assays with both amino acids.

Competition of L-Ala and L-Trp in Racemase Assay

% D-trp Formed (100% without L-Ala Assumed)

| Time (min) | A. caviae D76N | A. caviae D76N (Trp only control) | SEQ ID NO: 412pET28 purified | SEQ ID NO: 412pET28 purified (Trp only control) |
|---|---|---|---|---|
| 0 min | | | 65% | 100% |
| 5 min | 0% | 100% | 39% | 100% |
| 20 min | 54.6% | 100% | 96% | 100% |
| 60 min | 36.7% | 100% | 94% | 100% |
| 180 min | 36.4% | 100% | 110.6% | 100% |

Despite some initial inhibition of tryptophan racemization between zero and five minutes, with SEQ ID NO:412 there was little to no impact of L-alanine. SEQ ID NO:412 retained 96%-100% of its tryptophan racemase activity between 20 minutes to the end of the assay at three hours. In contrast, BAR *A. caviae* D76N only retained 37%-55% of its tryptophan racemase activity in the presence of L-alanine, during the same time period. Thus, the preference of SEQ ID NO:412 for tryptophan as a substrate is advantageous in the presence of competing substrates like alanine.

Example 9

Racemases Lacking Monatin Racemization Activity

TABLE 19

SEQ ID NO: 412 and *A. caviae* D76N do not racemize monatin

| | | | | Monatin Isomer Ratio | | |
|---|---|---|---|---|---|---|
| BAR | BAR ug | Vol Ptn | Time (hr) | % S, S | % R, S | % R, R |
| *A. caviae* (D76N) | 50 | 11.9 μL | 0 | 1.0 | 0.9 | 98.1 |
| SEQ ID NO: 412pET26b | 50 | 73 μL | 0 | 0.6 | 0.8 | 98.6 |
| SEQ ID NO: 412pET28 | 50 | 98 μL | 0 | 1.0 | 1.1 | 97.9 |
| Negative control | 0 | 0 | 0 | 0.4 | 0.1 | 98.5 |
| *A. caviae* (D76N) | 50 | | 24 | 0.6 | 1.0 | 98.4 |
| SEQ ID NO: 412pET26b | 50 | | 24 | 0.5 | 1.0 | 98.5 |
| SEQ ID NO: 412pET28 | 50 | | 24 | 0.4 | 1.3 | 98.3 |
| Negative control | 0 | | 24 | 0.6 | 0.9 | 98.5 |
| *A. caviae* (D76N) | 50 | | 48 | 0.4 | 0.7 | 98.9 |
| SEQ ID NO: 412pET26b | 50 | | 48 | 0.4 | 0.8 | 98.8 |
| SEQ ID NO: 412pET28 | 50 | | 48 | 1.3 | 0.5 | 98.2 |
| Negative control | 0 | | 48 | 0.4 | 0.7 | 98.9 |

Neither SEQ ID NO:412 nor the benchmark *A. caviae* BAR showed detectable racemization of R,R monatin under the conditions of the assay as described in Example 17.

TABLE 20

Racemase Substrate Specificity

| Designation | Alanine | R,R monatin | Vector/E. coli Host |
|---|---|---|---|
| Reference, *A. caviae* | +++ | − | pET30/BL21DE3 |
| SEQ ID NO: 412 | − (low, prefers trp) | − | pSE420/TOP10, pET28/BL21DE3 |
| *SEQ ID NO: 442 | + | − | pSE420/TOP10 |
| SEQ ID NO: 456 | + | − | pSE420/TOP10 |
| SEQ ID NO: 458 | + | − | pSE420/TOP10 |
| SEQ ID NO: 462 | + | − | pSE420/TOP10 |
| SEQ ID NO: 464 | + | − | pSE420/TOP10 |
| SEQ ID NO: 466 | + | − | pSE420/TOP10 |
| SEQ ID NO: 468 | + | − | pSE420/TOP10 |
| SEQ ID NO: 470 | + | − | pSE420/TOP10 |
| SEQ ID NO: 472 | +++ | − | pSE420/TOP10 |
| SEQ ID NO: 478 | + | − | pSE420/TOP10 |
| SEQ ID NO: 314 | + | − | pET30/BL21DE3 |
| SEQ ID NO: 326 | + | − | pET30/BL21DE3 |
| SEQ ID NO: 340 | not tested | − | pET30/BL21DE3 |
| SEQ ID NO: 342 | + | − | pET30/BL21DE3 |
| SEQ ID NO: 344 | ? | − | pET30/BL21DE3 |
| SEQ ID NO: 318 | + | − | pET30/BL21DE3 |
| SEQ ID NO: 330 | + | − | pET30/BL21DE3 |
| SEQ ID NO: 322 | + | − | pET30/BL21DE3 |
| SEQ ID NO: 324 | + | − | pET30/BL21DE3 |
| SEQ ID NO: 328 | + | − | pET30/BL21DE3 |
| SEQ ID NO: 346 | + | − | pET30/BL21DE3 |
| SEQ ID NO: 348 | ? | − | pET30/BL21DE3 |

TABLE 20-continued

Racemase Substrate Specificity

| Designation | Alanine | R,R monatin | Vector/E. coli Host |
|---|---|---|---|
| SEQ ID NO: 334 | + | − | pET30/BL21DE3 |
| SEQ ID NO: 350 | not tested | − | pET30/BL21DE3 |
| SEQ ID NO: 352 | + | − | pET30/BL21DE3 |

− indicates no detectable racemization under the conditions of the assays after a minimum of 24 hours
*indicates enzymes that were re-cloned in pET30a with a C-terminal His tag for purification and more quantitative assays Example 10

SEQ ID NO:412 is a Broad Specificity Amino Acid Racemase

The ability of purified SEQ ID NO:412 to racemize 7 additional L-amino acids was evaluated. The amino acid racemase assay was carried out as described in Example 17, with 30 mM of each L-amino acid substrate and approximately 1 µg of purified racemase candidate SEQ ID NO:412 (from pET28/BL21(DE3) induction) added for each amino acid substrate assayed.

TABLE 21

Additional substrates for SEQ ID NO: 412

| Starting substrate (L-amino acid) | µg/mL corresponding D-amino acid produced (2 hours) | Relative Activity (Trp taken as 100%) |
|---|---|---|
| Leucine | 2429.2 | 131.8% |
| Phenylalanine | 2193.5 | 119% |
| Tryptophan | 1843.5 | 100% |
| Methionine | 1387.7 | 75.3% |
| Tyrosine | 154.1 | 8.36% |
| Alanine | 132.3 | 7.18% |
| Lysine | 49.3 | 2.67% |
| Aspartic acid | 23 | 1.25% |
| Glutamate | 1.9 | 0.1% |

SEQ ID NO:412 appears to be an amino acid racemase with broad substrate specificity and seems to prefer bulky, hydrophobic amino acids.

Racemase activity for various amino acids as substrates was observed as follows, under the conditions of the assay as described: [Leucine/Phenylalanine/Tryptophan/Methionine]>[Tyrosine/Alanine]>[Lysine/Aspartic Acid]>Glutamate.

It should be noted that analytical methods for detection of all of the above D-amino acids with the exception of tryptophan are semi-quantitative so these results indicate a trend in racemase activity.

Example 11

Methods to Improve Solubility of an Insoluble Protein and its Activity on Tryptophan SEQ ID NO:412 showed lower solubility than other racemase candidates described in this application, under the expression conditions tested. The SEQ ID NO:412 insoluble protein fraction was tested for racemization activity on tryptophan.

Cell-free extracts of pET28/24431 were prepared from frozen cell pellets by adding 5 ml of Bugbuster Amine Free (Novagen/EMD Biosciences, San Diego, Calif.) with 5 µL/mL of Protease Inhibitor Cocktail II (Calbiochem, San Diego, Calif.) and 1 µl/ml of benzonase nuclease (Novagen/EMD Biosciences, San Diego, Calif.), per gm of cell pellet. Cell pellet suspensions were incubated at room temperature with gentle mixing for 15 min; cells pellets were spun out at 14000 rpm for 20 min (at 4° C.) and retained for assays.

Cell pellets containing insoluble SEQ ID NO:412 racemase were washed multiple times in phosphate buffered saline to remove traces of supernatant containing soluble SEQ ID NO:412 protein fraction. Washed pellets were used in qualitative tryptophan assays (amount of protein in assay was not quantitated, rather a set volume of pellet resuspended in phosphate buffer was added to assay). The experiment was performed twice, once with pellets that were washed four times, and the second time with frozen pellets that were thawed and washed an additional six times. Tryptophan racemization assays were performed on the insoluble protein suspension as described in Example 17.

Table 22. SEQ ID NO:412 Insoluble Protein Assays

Active Pellets

A. D-trp Production (µg/mL) in Pellets Washed 10× And after Freeze Thaw

| Time (hr) | pET28 - 2 uL | pET28 - 20 uL |
|---|---|---|
| 0 | nd | nd |
| 0.16 | 44 | 353 |
| 1 | 137 | 2437 | nd = not detected under the conditions of the assay as described above

B. D-trp Production (µg/mL) in Pellets Washed 4× with Phosphate Buffer

| Time (hr) | pET28 2 uL | pET28 20 uL |
|---|---|---|
| 0 | nd | 19 |
| 0.16 | 153 | 681 |
| 1 | 831 | 2225 | nd = not detected under the conditions of the assay as described above

SDS-PAGE analysis of cell pellets/insoluble protein fraction from the Bugbuster protocol above, showed a predominant protein band at the expected size (56.3 kD) for SEQ ID NO:412 racemase. Insoluble SEQ ID NO:412/pET28 protein fraction was observed to have tryptophan racemase activity. D-tryptophan production in the case of 20 µl samples was comparable between the two trials. The variation observed in the case of the 2 µl samples could be attributed to the small volume and sample nature (insoluble protein suspension).

Preliminary investigations indicated that SEQ ID NO:412 is not a membrane associated protein, which might be a possibility given the lack of solubility but the presence of activity in SEQ ID NO:412.

Experiments to Improve Solubility of SEQ ID NO:412

Various host systems reported to improve soluble expression of heterologous proteins were investigated in an effort to improve soluble expression of SEQ ID NO:412 racemase: E. coli KRX (Promega, Madison, Wis.), CopyCutter™ EPI400™ (Epicentre Biotechnologies, Madison, Wis.), ArcticExpress™ (Stratagene, La Jolla, Calif.), E. coli HMS174 (Novagen/EMD Biosciences, San Diego, Calif.), and E. coli EE2D.

A. Induction in ArcticExpress™

Competent cells of ArcticExpress™ (DE3) were transformed with pET28/24431 and pET26b/24431 as per manufacturer's protocol (Stratagene, La Jolla, Calif.). Transformants were grown in LB containing kanamycin (50 mg/L) and gentamycin (20 mg/L) overnight at 37° C. and 250 rpm. A 2% inoculum was transferred to 50 mL OVERNIGHTEXPRESS™ media containing kanamycin and gentamycin. Flasks were grown for 1.5 days at 15° C. and 250 rpm. Cells were harvested and cell extracts prepared as described in herein. SDS-PAGE analysis of total and soluble protein was conducted.

No improvement was seen in solubility in the ARCTICEXPRESS™ strain. However, the chaperonin proteins that should be overexpressed in this strain were not observed (expected sizes of 10 kDa and 60 kDa) on the SDS-PAGE gel. The experiment was repeated with fresh competent cells and induction over 3 days, but SDS results were identical.

When the ARCTICEXPRESS™ experiments were repeated with the pET28/24431 construct using the methods of Part A, the data showed an improvement in soluble protein expression (see Example 1).

B. Induction in *E. Coli* Copycutter™

COPYCUTTER EPI400™ cells were transformed with pET28/SEQ ID NO:412 as per manufacturer instructions (Epicentre Biotechnologies, Madison, Wis.). Liquid cultures of transformants were grown overnight (LB kanamycin 50, 37° C., 250 rpm) and used to inoculate shake flasks containing 25 mL LB media, kanamycin (50 mg/L) and 1× CopyCutter™ induction solution. Cultures were grown at 30° C. and 250 rpm for 5 hours. Cultures were harvested and cell extracts were prepared as described herein. SDS-PAGE analysis of total and soluble protein was conducted.

C. Induction in *E. Coli* HMS174 and EE2D DE3

*E. coli* HMS174 (Novagen/EMD Biosciences, San Diego, Calif.) and *E. coli* BW30384(DE3) ΔompTΔmetE ("*E. coli* EE2D") competent cells were transformed with pET28/SEQ ID NO:412. (Construction of the *E. coli* BW30384(DE3) ΔompTΔmetE expression host and the transformation protocol are described in WO 2006/066072. Liquid cultures of transformants were grown overnight (LB kanamycin 50, 37° C., 250 rpm) and used to inoculate 50 mL shake flasks of overnight express media containing kanamycin (50 mg/L). Cultures were grown at 30° C. and 250 to an $OD_{600}$>10. Cultures were harvested and cell extracts were prepared as described herein. SDS-PAGE analysis of total and soluble protein was conducted.

In all cases described above, no significant increase in soluble expression of SEQ ID NO:412 was observed based on SDS-PAGE analyses. In addition, SEQ ID NO:412 was subcloned into a derivative of the pET23d vector (Novagen, Madison, Wis.) containing the *E. coli* metE gene and promoter inserted at the NgoMIV restriction site and a second psil restriction site that was added for facile removal of the beta-lactamase gene (bla). The construction of this vector is described in WO 2006/066072. This construct was transformed into *E. coli* B834 DE3 host system (Novagen/EMD Biosciences, San Diego, Calif.), without significant increase in soluble expression.

Since SEQ ID NO:412 with its native leader sequence could not be successfully cloned and propagated under the conditions described in Part A, a N-terminal alanine residue was added in place of the native leader sequence of SEQ ID NO:412. It was determined that deletion of this additional alanine residue had no impact on soluble expression, based on SDS-PAGE analysis.

The presence of DTT was shown to minimize protein precipitation during purification of selected histidine-tagged D-aminotransferase candidates. The addition of 5 mM DTT during the bugbuster solubilization and subsequent purification of histidine-tagged SEQ ID NO:412 from pET28/BL21DE3 induction did not impact soluble expression as observed on SDS-PAGE.

One skilled in the art could employ various methods reported in the literature to improve soluble expression of the protein.

Example 12

Analysis of Racemases Provided as pSE420 Clones

SEQ ID NO:412, SEQ ID NO:416, SEQ ID NO:418, SEQ ID NO:420, SEQ ID NO:422, SEQ ID NO:424, SEQ ID NO:122, SEQ ID NO:428, SEQ ID NO:430, SEQ ID NO:432, SEQ ID NO:434, SEQ ID NO:436, SEQ ID NO:438 and SEQ ID NO:440 racemases were provided as pSE420 clones. One skilled in the art could synthesize the genes encoding these racemases using various published techniques for example, as described in Stemmer et al., supra. The plasmids were transformed into *E. coli* TOP 10 chemically competent cells (Invitrogen, Carlsbad, Calif.). Overnight cultures grown in LB carbenicillin (100 µg/ml) were diluted a hundred-fold in 50 ml LB carbenicillin (100 g/ml) in a 250 ml baffled flask. Cultures were grown at 30° C. with agitation at 250 rpm until they reached an $OD_{600}$ of 0.5 to 0.8, after which protein expression was induced with 1 mM IPTG for 4 h at 30° C. Samples for total protein were taken prior to induction and right before harvesting. Cells were harvested by centrifugation. Cells were frozen at −80° C.

Cell extracts were typically prepared from the above frozen pellets by adding 5 ml per g of cell pellet of Bugbuster Amine Free (Novagen/EMD Biosciences, San Diego, Calif.) with 5 µL/mL of Protease Inhibitor Cocktail II (Calbiochem, San Diego, Calif.) and 1 µl/ml of benzonase nuclease (Novagen/EMD Biosciences, San Diego, Calif.). Cell solutions were incubated at room temperature with gentle mixing for 15 min; cells were spun out at 14000 rpm for 20 min (at 4° C.) and the supernatant was carefully removed. Detergents and low molecular weight molecules were removed by passage through PD-10 columns (GE Healthcare, Piscataway, N.J.) previously equilibrated with 100 mM potassium phosphate (pH 7.8) with 0.05 mM PLP. Proteins were eluted with 3.5 mL of the same buffer. Total protein concentration was determined using the Pierce BCA total protein assay with bovine serum albumin (BSA) as the standard, per the manufacturer's instructions (Pierce Biotechnology, Inc., Rockford, Ill.). The resulting cell-free extract was used for subsequent assays.

For the tryptophan racemase assay a total of 650 µg of desalted protein was added for each enzyme based on Pierce BCA total protein analysis with BSA as the standard (Pierce Biotechnology, Inc., Rockford, Ill.). Formation of D-tryptophan was measured at 30 minutes, 2 hours, 4 hours and 24 hours. pSE420 cell-free extract of SEQ ID NO:412 served as a positive control for the assay, and cell-free extract of empty vector pSE420 served as a negative control.

TABLE 23

D-trp production, (pSE420 constructs)
D-trp production, µg/mL

| Enzyme | 30 min | 2 hours | 4 hours | 24 hours |
|---|---|---|---|---|
| pSE420 vector control | nd | nd | nd | nd |
| SEQ ID NO: 412 | 25 | 79 | 126 | 582 |
| SEQ ID NO: 416 | 82 | 336 | 568 | 2344 |
| SEQ ID NO: 418 | 59 | 209 | 307 | 1346 |
| SEQ ID NO: 420 | nd | nd | nd | nd |
| SEQ ID NO: 422 | nd | nd | nd | nd |
| SEQ ID NO: 424 | 1407 | *no data | 3322 | 2564 |
| SEQ ID NO: 122 | nd | nd | nd | nd |
| SEQ ID NO: 428 | nd | nd | nd | nd |
| SEQ ID NO: 430 | nd | nd | nd | nd |
| SEQ ID NO: 432 | nd | nd | nd | nd |
| SEQ ID NO: 434 | nd | nd | nd | nd |
| SEQ ID NO: 436 | nd | nd | nd | nd |
| SEQ ID NO: 438 | nd | nd | nd | nd |
| SEQ ID NO: 440 | 864 | 2213 | 3022 | 3947 | nd = not detected under the conditions of the assay as described above
*sample was not tested Racemases SEQ ID NO:420, SEQ ID NO:422, SEQ ID NO:122, SEQ ID NO:428, SEQ ID NO:430, SEQ ID NO:432, SEQ ID NO:434, SEQ ID NO:436, and SEQ ID NO:438 showed no detectable tryptophan racemase activity after 24 hours under the conditions tested. (Under the conditions described in Part A, good activity was observed for SEQ ID NO:420, SEQ ID NO:422, SEQ ID NO:122, and SEQ ID NO:438; very slight activity was detected for SEQ ID NO:428, SEQ ID NO:434, and SEQ ID NO:436; and no activity was detected for SEQ ID NO:440).

Racemases SEQ ID NO:416, SEQ ID NO:418, SEQ ID NO:424 and SEQ ID NO:440 showed appreciable tryptophan activity in this assay. These were PCR amplified with and without C-terminal His tags for subcloning into pET30a. The oligonucleotides used for amplification are shown in Table 24.

TABLE 24

Oligonucleotide primers

| Primer | | SEQ ID NO: |
|---|---|---|
| SEQ ID NO: 416 R XhoI no stop | GGCCTTAACTCGAGGCGGTTGATCTTCTTGGG GTTG | 506 |
| SEQ ID NO: 416 F NdeI | GGCCTTAACATATGGCTCCCTATCTGCCCCTTG TGAC | 507 |
| SEQ ID NO: 416 R XhoI no stop | CCTTGGAACTCGAGTTAGCGGTTGATCTTCTTGG | 508 |
| SEQ ID NO: 418 F NdeI | GGCCTTAACATATGGCCCCTTACCTGCCGCTG | 509 |
| SEQ ID NO: 418 R SaI 1 with stop | CCGGAACCTTGGAACCGTCGACTTAGCGTTT GATCTTCTTGGG | 510 |
| SEQ ID NO: 418 R SaI 1 no stop | GGCCTTAACCTTGTCGACGCGTTTGATCTT CTTGGGGTTGGTGTAG | 511 |
| SEQ ID NO: 424 F NdeI | GGCCTTAACATATGGCTCCACCGCTGTCGATG GACAAC | 512 |
| SEQ ID NO: 440 F NdeI | GGCCTTAACATATGGCTAGCAATGCCTGGGTGG AGATAGAC | 513 |
| SEQ ID NO: 440 R XhoI with stop | GGCCTTAACTCGAGTTAGGTGTTGCCCCAGACG GTGTAC | 514 |
| SEQ ID NO: 440 R XhoI no stop | GGCCTTAACTCGAGGGTGTTGCCCCAGACGGT GTACATGTCC | 515 |

Tagged and untagged constructs were sequenced for accuracy (Agencourt Bioscience Inc., Beverly Mass.) and transformed into BL21DE3; transformants were grown and induced in Overnight Express media and cell-free extracts were prepared as described herein. Racemase candidate proteins were purified from tagged constructs and desalted on PD-10 columns. Untagged racemase candidate cell-free extracts were desalted on PD-10 columns. Protein concentrations were determined by Pierce BCA protein assay (Pierce Biotechnology, Inc., Rockford, Ill.) and racemase purity was estimated by Experion Automated Gel System (Experion, version A.01.10, Biorad, Hercules, Calif.).

Racemase assays were performed on purified and crude protein extracts as described in Example 17. Purified SEQ ID NO:412 protein served as a positive control. For the assay 5 µg of equivalent BAR protein was added for the positive control SEQ ID NO:412, and an estimated 50 µg equivalent BAR protein was added for each of the other enzymes based on Pierce BCA total protein analysis and racemase purity estimation by Experion Automated Gel System (Experion, version A.01.10™, Biorad, Hercules, Calif.).

TABLE 25

D-trp production
D-trp production, µg/mL

| Enzyme | 0.5 hr | 2 hr | 4 hr |
|---|---|---|---|
| SEQ ID NO: 412pET28 purified | 2197 | 2431 | 3186 |
| SEQ ID NO: 416 pET30 purified | 52 | 54 | 134 |
| SEQ ID NO: 418pET30 purified | 187 | 533 | 664 |
| SEQ ID NO: 424 pET30 purified | nd | nd | nd |
| SEQ ID NO: 440 pET30 purified | nd | nd | nd |
| SEQ ID NO: 416 CFE | nd | 84 | 100 |
| SEQ ID NO: 418 CFE | 36 | 82 | 74 |

TABLE 25-continued

| | D-trp production D-trp production, µg/mL | | |
|---|---|---|---|
| Enzyme | 0.5 hr | 2 hr | 4 hr |
| SEQ ID NO: 424 CFE | nd | nd | nd |
| SEQ ID NO: 440 CFE | nd | nd | nd | nd = not detected under the conditions of the assay as described above
4 candidates that appeared to have higher activity than SEQ ID NO: 412-SEQ ID NO: 416, SEQ ID NO: 418, SEQ ID NO: 424, SEQ ID NO: 440 not replicated in pET30 with BL21DE3 host all experiments conducted with purified protein (approx 50 µg BAR) Previously shown in Part A that there are striking differences in activity when the same construct in three different host backgrounds.

Extracts of SEQ ID NO:416, SEQ ID NO:418, SEQ ID NO:424 and SEQ ID NO:440 in pSE420/TOP10 exhibited tryptophan racemase activity, while extracts from the same clones in pET30/BL21DE3 did not exhibit or exhibited very little tryptophan racemase activity. SEQ ID NO:424 and SEQ ID NO:440 showed no detectable tryptophan racemase activity in purified or crude cell extracts when cloned into pET30 and expressed in *E. coli* BL21DE3, under the conditions tested. SEQ ID NO:416 and SEQ ID NO:418 showed tryptophan racemase activity for both purified and crude extracts.

Since variations in racemase activity were observed with SEQ ID NO:416, SEQ ID NO:418, SEQ ID NO:424 and SEQ ID NO:440 in different vector and host backgrounds, the reproducibility in the original pSE420 vector was investigated. [It is noted that the SEQ ID NO:424 racemase candidate could not be revived from glycerol stocks.] Racemase assay was repeated using 1 mg total protein (from pSE420/TOP10 cell-free extracts) of SEQ ID NO:416, SEQ ID NO:418 and SEQ ID NO:440 (and same assay conditions as the original assay—results shown in FIG. 10. The 3 clones showed severely diminished racemase activity (see FIG. 12). Comparison of the racemase activity for SEQ ID NO:416, SEQ ID NO:418 and SEQ ID NO:440 in FIGS. 10 and 12 shows that inconsistent results were obtained despite using the same vector/host background.

Conditions described under Part A resulted in similar observations of clone/construct instability of a few of the racemase candidates.

TABLE 26

| | D-trp production D-trp production, µg/mL | | |
|---|---|---|---|
| Enzyme | 0.5 hr | 2 hr | 4 hr |
| pSE420 vector control | nd | nd | nd |
| SEQ ID NO: 412 | 636 | 1672 | 3154 |
| SEQ ID NO: 416 | 11 | nd | 78 |
| SEQ ID NO: 418 | 31 | 139 | 187 |
| SEQ ID NO: 440 | nd | 2 | nd | nd = not detected under the conditions of the assay as described above

The host organisms, expression conditions, and post expression cell handling can all affect whether there is detectable tryptophan racemase activity under the conditions of the assay. Additionally, under optimized conditions, it is expected that all racemase candidates could have tryptophan racemase activity.

Racemase candidates were grouped by amino acid sequence homology, with clusters having 95% or greater homology at amino acid level to a reference sequence. One or more representatives was/were chosen from each group for characterization of tryptophan racemase activity under the conditions described in Part B.

Using SEQ ID NO:110 as the reference sequence, the following racemase candidates had 97% or greater identity at amino acid level to the above reference sequence: SEQ ID NO:136, SEQ ID NO:174, SEQ ID NO:138, SEQ ID NO:296. SEQ ID NO:416 is a non-leadered version of the reference SEQ ID NO:110 sequence. Under the conditions described in Part B (see, for example, Example 17), tryptophan racemase activity was detected for the non-leadered version (SEQ ID NO:416) of the reference candidate, SEQ ID NO:110. Thus, it would be expected that other racemase candidates with 97% or greater sequence identity at the amino acid level would also have tryptophan racemase activity.

Using SEQ ID NO:116 as the reference sequence, the following racemase candidates had 97% or greater identity at amino acid level to the above reference sequence: SEQ ID NO:150, SEQ ID NO:192, SEQ ID NO:152, SEQ ID NO:118, SEQ ID NO:194, SEQ ID NO:154, SEQ ID NO:196, SEQ ID NO:158, SEQ ID NO:160. SEQ ID NO:420 is a non-leadered version of the reference SEQ ID NO:116 sequence. SEQ ID NO:422 is a non-leadered version of the reference SEQ ID NO:118 sequence. Under the conditions described in Part B (e.g., Example 17), tryptophan racemase activity was not detected for SEQ ID NO:420 and SEQ ID NO:422 which are the non-leadered versions of SEQ ID NO:116 and SEQ ID NO:118 respectively—however, activity was not observed under the assay conditions described in Part A. The host organisms, expression conditions, and post-expression cell handling can all affect whether there is detectable tryptophan racemase activity under the conditions of the assay. Additionally, under optimized conditions or as shown in the assay conditions described in Part A, it is expected that all the above racemase candidates could have tryptophan racemase activity.

It is expected that the presence of activity in a polypeptide encoded from a subcloned nucleic acid is predictive of the presence of activity in the corresponding polypeptide encoded from the full-length or wild type nucleic acid.

TABLE 27

| Sub-clone number | Wild-Type Clone |
|---|---|
| SEQ ID NO: 416 | SEQ ID NO: 110 |
| SEQ ID NO: 418 | SEQ ID NO: 112 |
| SEQ ID NO: 424 | SEQ ID NO: 50 |
| SEQ ID NO: 440 | SEQ ID NO: 440 |

Example 13

Analysis of Racemases Provided as pSE420 Clones

SEQ ID NO:442, SEQ ID NO:444, SEQ ID NO:446, SEQ ID NO:448, SEQ ID NO:450, SEQ ID NO:452, and SEQ ID NO:454 racemases were provided as pSE420 clones. One skilled in the art can synthesize the genes encoding these racemases using various published techniques for example, as described in Stemmer et al., supra. The plasmids were transformed into TOP10-chemically competent cells (Invitrogen, Carlsbad, Calif.). Overnight cultures growing in LB carbenicillin (100 µg/ml) were diluted 100× in 50 ml LB carbenicillin in a 250 ml baffled flask. Cultures were grown at 30° C. and 250 rpm until they reached an $OD_{600}$ of 0.5 to 0.8, after which protein expression was induced with 1 mM IPTG for 4 h at 30° C. Samples for total protein were taken prior to induction and right before harvesting. Cells were harvested by centrifugation. Cells were frozen at −80° C.

Cell extracts were typically prepared from the above frozen pellets by adding 5 ml per g of cell pellet of Bugbuster Amine Free (Novagen/EMD Biosciences, San Diego, Calif.) with 5 µL/mL of Protease Inhibitor Cocktail II (Calbiochem, San Diego, Calif.) and 1 µl/ml of benzonase nuclease (Novagen/EMD Biosciences, San Diego, Calif.). Cell solutions were incubated at room temperature with gentle mixing for 15 min; cells were spun out at 14000 rpm for 20 min (at 4° C.) and the supernatant was carefully removed. Detergents and low molecular weight molecules were removed by passage through PD-10 columns (GE Healthcare, Piscataway, N.J.) previously equilibrated with 100 mM potassium phosphate (pH 7.8) with 0.05 mM PLP. Proteins were eluted with 3.5 mL of the same buffer. Total protein concentration was determined using the Pierce BCA protein assay (Pierce Biotechnology, Inc., Rockford, Ill.) with bovine serum albumin (BSA) as the standard, per the manufacturer's instructions. The resulting cell-free extract was used for subsequent assays.

Tryptophan racemase assays were carried out under the conditions described in Example 17. For the tryptophan racemization assay, a total of 1 mg of soluble protein (based on Pierce BCA total protein analysis with BSA as the standard) was added for each racemase candidate and positive controls. pSE420/TOP10 cell-free extract of SEQ ID NO:412 served as positive control for the assay, and cell-free extract of E. coli TOP10 (Invitrogen, Carlsbad, Calif.) containing vector pSE420 served as a negative control. Total protein concentration was determined using the Pierce BCA protein assay (Pierce Biotechnology, Inc., Rockford, Ill.) with bovine serum albumin (BSA) as the standard, per the manufacturer's instructions. Formation of D-tryptophan was measured at 30 minutes, 2 hours and 4 hours as described in Example 18.

TABLE 28

D-trp production
D-trp production, µg/mL

| Enzyme | 0.5 hr | 2 hr | 4 hr |
| --- | --- | --- | --- |
| pSE420 vector control | nd | nd | nd |
| SEQ ID NO: 412 | 636 | 1672 | 3154 |
| SEQ ID NO: 442 | 678 | 2107 | 3346 |
| SEQ ID NO: 444 | 105 | 457 | 758 |
| SEQ ID NO: 446 | 312 | 1549 | 1934 |
| SEQ ID NO: 448 | 6 | 42 | nd |
| SEQ ID NO: 450 | 23 | 66 | 33 |
| SEQ ID NO: 452 | 32 | 36 | 85 |
| SEQ ID NO: 454 | 257 | 577 | 888 | nd = not detected under the conditions of the assay as described above

All of the racemase candidate extracts tested above, SEQ ID NO:442, SEQ ID NO:444, SEQ ID NO:446, SEQ ID NO:448, SEQ ID NO:450, SEQ ID NO:452 and SEQ ID NO:454, had detectable tryptophan racemase activity under the conditions described above. In addition, tryptophan racemase activity was detected for the positive control SEQ ID NO:412 extract and there was no detectable activity in the case of the pSE420 vector control extracts. It is expected that the homologs of the representative racemase candidates having 95% or greater homology at amino acid level (see Table 29) will also have tryptophan racemase activity.

TABLE 29

| Enzyme | 0.5 hr | 2 hr | 4 hr |
| --- | --- | --- | --- |
| pSE420 vector control | nd | nd | nd |
| SEQ ID NO: 412 | 636 | 1672 | 3154 |
| SEQ ID NO: 442 | 678 | 2107 | 3346 |

TABLE 29-continued

| Enzyme | 0.5 hr | 2 hr | 4 hr |
| --- | --- | --- | --- |
| SEQ ID NO: 444 | 105 | 457 | 758 |
| SEQ ID NO: 446 | 312 | 1549 | 1934 |
| SEQ ID NO: 448 | 6 | 42 | nd |
| SEQ ID NO: 450 | 23 | 66 | 33 |
| SEQ ID NO: 452 | 32 | 36 | 85 |
| SEQ ID NO: 454 | 257 | 577 | 888 | nd, not detected under the conditions of the assay as described above

Racemase candidates described in this example were grouped by amino acid sequence homology with clusters having 95% or greater homology at amino acid level to a reference sequence. One or more representatives were chosen from each group for characterization of tryptophan racemase activity using the conditions described in Part B. Using SEQ ID NO:244 as the reference sequence, the following racemase candidates had 97% or greater identity at amino acid level to the above reference sequence: SEQ ID NO:248, SEQ ID NO:236, SEQ ID NO:246, SEQ ID NO:252, SEQ ID NO:250, and SEQ ID NO:254. SEQ ID NO:448 is a non-leadered version of the reference SEQ ID NO:244 sequence. Under the conditions described in Part B (e.g., Example 17), tryptophan racemase activity was detected for the non-leadered version (SEQ ID NO:448) of the reference candidate, SEQ ID NO:244; as well as the non-leadered version (SEQ ID NO:450) of the candidate, SEQ ID NO:248. Thus, it would be expected that other racemase candidates with 97% or greater sequence identity at the amino acid level would also have tryptophan racemase activity.

Using SEQ ID NO:288 as a reference sequence, the following racemase candidates had 97% or greater identity at amino acid level to the above reference sequence: SEQ ID NO:274, SEQ ID NO:234, SEQ ID NO:220, SEQ ID NO:222, SEQ ID NO:226, SEQ ID NO:232, SEQ ID NO:240, SEQ ID NO:242, SEQ ID NO:258, SEQ ID NO:260, SEQ ID NO:264, SEQ ID NO:266, SEQ ID NO:286, SEQ ID NO:290, SEQ ID NO:170, and SEQ ID NO:216. SEQ ID NO:454 is a non-leadered version of the reference SEQ ID NO:288 sequence; SEQ ID NO:452 is a non-leadered version of SEQ ID NO:274 sequence; and SEQ ID NO:446 is a non-leadered version of SEQ ID NO:234 sequence. Under the conditions of the assay as described in Example 17, tryptophan racemase activity was detected for the non-leadered version (SEQ ID NO:454) of the reference candidate, SEQ ID NO:288; as well as the non-leadered versions (SEQ ID NO:452 and SEQ ID NO:446) of racemase candidates SEQ ID NO:274 and SEQ ID NO:234, respectively. Thus, it would be expected that other racemase candidates listed above with 97% or greater sequence identity at the amino acid level would also have tryptophan racemase activity.

Using SEQ ID NO:218 as a reference sequence, the following racemase candidates had 97% or greater identity at amino acid level to the above reference sequence: SEQ ID NO:208, SEQ ID NO:210, SEQ ID NO:228, SEQ ID NO:230, SEQ ID NO:270, SEQ ID NO:272, SEQ ID NO:278, SEQ ID NO:280, SEQ ID NO:282, SEQ ID NO:284, SEQ ID NO:292, SEQ ID NO:198, SEQ ID NO:212, SEQ ID NO:214, and SEQ ID NO:114. SEQ ID NO:204 had 96% identity with SEQ ID NO:218 reference sequence. SEQ ID NO:444 is a non-leadered version of the reference SEQ ID NO:218 sequence. Under the conditions described in Part B (e.g., Example 17), tryptophan racemase activity was detected for the non-leadered version (SEQ ID NO:444) of the reference candidate, SEQ ID NO:218. Thus it would be expected that other racemase candidates with 97% or greater sequence identity at the amino acid level would also have tryptophan racemase activity.

SEQ ID NO:436 is a non-leadered version of SEQ ID NO:114 sequence. Under the conditions of the assays described in Part B, tryptophan racemase activity was not detected for the non-leadered version (SEQ ID NO:436) of the racemase candidate SEQ ID NO:114, as shown in Example 12.

SEQ ID NO:442 was Subcloned into pET30a with a C-Terminal His Tag

A D56N mutant (corresponding to D76N mutation in *A. caviae*) was created in SEQ ID NO:442. Mutagenesis was done using the QuickChange-Multi site-directed mutagenesis kit (Stratagene, La Jolla, Calif.), using the C-tagged SEQ ID NO:442 gene in pET30a as template. The following mutagenic primer was used to make the D56N change as described in Example 19: 5'-CGCCATCATGAAGGC-GAACGCCTACGGTCACG-3' (SEQ ID NO:516).

The site-directed mutagenesis was done as described in the manufacturer's protocol. The resulting mutation was detrimental to tryptophan racemase activity in this candidate.

It is expected that the presence of activity in a polypeptide encoded from a subcloned nucleic acid is predictive of the presence of activity in the corresponding polypeptide encoded from the full-length or wild type nucleic acid.

TABLE 30

| Sub-clone number | Wild-Type Clone |
| --- | --- |
| SEQ ID NO: 442 | SEQ ID NO: 224 |
| SEQ ID NO: 444 | SEQ ID NO: 218 |
| SEQ ID NO: 446 | SEQ ID NO: 234 |
| SEQ ID NO: 448 | SEQ ID NO: 244 |
| SEQ ID NO: 450 | SEQ ID NO: 248 |
| SEQ ID NO: 452 | SEQ ID NO: 274 |
| SEQ ID NO: 454 | SEQ ID NO: 288 |

Example 14

Analysis of Racemases Provided as pSE420 Clones

SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, and SEQ ID NO:478 racemases were provided as pSE420 clones. One skilled in the art can synthesize the genes encoding these racemases using various published techniques for example, as described in Stemmer et al., supra. The plasmids were transformed into *E. coli* TOP10 chemically competent cells (Invitrogen, Carlsbad, Calif.). Overnight cultures growing in LB carbenicillin (100 mg/ml) were diluted 100× in 50 ml LB carbenicillin (100 μg/ml) in a 250 ml baffled flask. Cultures were grown at 30° C. at 250 rpm until they reached an $OD_{600}$ of 0.5 to 0.8, after which protein expression was induced with 1 mM IPTG for 4 h at 30° C. Samples for total protein were taken prior to induction and right before harvesting. Cells were harvested by centrifugation and frozen at −80° C.

Cell extracts were typically prepared from the above frozen pellets by adding 5 ml per g of cell pellet of Bugbuster Amine Free (Novagen/EMD Biosciences, San Diego, Calif.) with 5 μL/mL of Protease Inhibitor Cocktail II (Calbiochem, San Diego, Calif.) and 1 μl/ml of benzonase nuclease (Novagen/EMD Biosciences, San Diego, Calif.). Cell solutions were incubated at room temperature with gentle mixing for 15 min; cells were spun out at 14,000 rpm for 20 min (at 4° C.) and the supernatant was carefully removed. Detergents and low molecular weight molecules were removed by passage through PD-10 columns (GE Healthcare, Piscataway, N.J.) previously equilibrated with 100 mM potassium phosphate (pH 7.8) with 0.05 mM PLP. Proteins were eluted with 3.5 mL of the same buffer. Total protein concentration was determined using the Pierce BCA (Pierce Biotechnology, Inc., Rockford, Ill.) protein assay with bovine serum albumin (BSA) as the standard, per the manufacturer's instructions. The resulting cell-free extract was used for subsequent assays.

Desalted cell-free extracts of racemase candidates SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478 were prepared as described in other examples.

Tryptophan racemase assays were carried out under the conditions described in Example 17. For the tryptophan racemization assay a total of 800 μg of soluble protein was added for each racemase candidate and positive controls. pSE420/TOP10 cell-free extracts of SEQ ID NO:412 and SEQ ID NO:442 served as positive controls for the assay, and cell-free extract of *E. coli* TOP10 (Invitrogen, Carlsbad, Calif.) containing vector pSE420 served as a negative control. Total protein concentration was determined using the Pierce BCA (Pierce Biotechnology, Inc., Rockford, Ill.) protein assay with bovine serum albumin (BSA) as the standard, per the manufacturer's instructions. Formation of D-tryptophan was measured at 30 minutes, 2 hours and 4 hours as described in Example 18.

TABLE 31

| | D-trp production | | |
| --- | --- | --- | --- |
| | D-trp production, μg/mL | | |
| Enzyme | 0.5 hr | 2 hr | 4 hr |
| pSE420 | nd | nd | nd |
| SEQ ID NO: 412 | 834 | 1861 | 2803 |
| SEQ ID NO: 442 | 911 | 1863 | 2912 |
| SEQ ID NO: 456 | nd | nd | nd |
| SEQ ID NO: 458 | nd | nd | nd |
| SEQ ID NO: 460 | 11 | 5 | 105 |
| SEQ ID NO: 462 | nd | nd | nd |
| SEQ ID NO: 464 | nd | nd | nd |
| SEQ ID NO: 466 | nd | nd | nd |
| SEQ ID NO: 468 | nd | nd | nd |
| SEQ ID NO: 470 | nd | nd | nd |
| SEQ ID NO: 472 | nd | nd | nd |
| SEQ ID NO: 474 | 121 | 455 | 1101 |
| SEQ ID NO: 476 | 28 | 100 | 249 |
| SEQ ID NO: 478 | nd | nd | nd | nd = not detected under the conditions of the assay as described.

Racemase candidates SEQ ID NO:460, SEQ ID NO:474 and SEQ ID NO:476 showed tryptophan racemase activity. Racemases SEQ ID NO:456, SEQ ID NO:458, SEQ ID NO:462, SEQ ID NO:464, SEQ ID NO:466, SEQ ID NO:468, SEQ ID NO:470, SEQ ID NO:472 and SEQ ID NO:478 showed no detectable tryptophan racemase activity after 4 hours under the conditions tested. In a follow up experiment, a 24-hour sample was evaluated for D-tryptophan production. None of the racemases listed above showed detectable tryptophan racemase activity at 24 hours under the conditions described above. Of the candidates for which no activity was observed, SEQ ID NO:456, SEQ ID NO:458, SEQ ID NO:462, SEQ ID NO:464, SEQ ID NO:466, SEQ ID NO:468, SEQ ID NO:470, SEQ ID NO:472 and SEQ ID NO:478 exhibited poor or questionable soluble protein expression. The host organisms, expression conditions, and post expression cell handling can all affect whether there is detectable tryptophan racemase activity under the conditions of the assay. Additionally, under optimized conditions, it is expected that all racemase candidates could have tryptophan racemase activity.

Racemase candidates were grouped by amino acid sequence homology, with clusters having 95% or greater homology at amino acid level to a reference sequence. One or more representatives was/were chosen from each group for characterization of tryptophan racemase activity using the conditions described in Part B.

Using SEQ ID NO:108 as the reference sequence, the following racemase candidates had 96% or greater identity at amino acid level to the above reference sequence: SEQ ID NO:172, SEQ ID NO:178, SEQ ID NO:180, SEQ ID NO:182, SEQ ID NO:184, SEQ ID NO:140, SEQ ID NO:144, SEQ ID NO:188, SEQ ID NO:190, SEQ ID NO:112, SEQ ID NO:148, SEQ ID NO:156, SEQ ID NO:120 and SEQ ID NO:162. SEQ ID NO:474 is a non-leadered version of the reference SEQ ID NO:108 sequence. Under the conditions described in Part B (e.g., Example 17), tryptophan racemase activity was detected for the non-leadered version (SEQ ID NO:474) of the reference candidate, SEQ ID NO:108, as well as the non-leadered version (SEQ ID NO:460) of SEQ ID NO:120 which is 97% identical with the reference candidate, SEQ ID NO:108. Additionally the non-leadered version (SEQ ID NO:418) of SEQ ID NO:112 was shown to have detectable tryptophan racemase activity as seen in Example 12. Thus it would be expected that the other racemase candidates listed above, with 96% or greater sequence identity at the amino acid level would also have tryptophan racemase activity.

It is expected that the presence of activity in a polypeptide encoded from a subcloned nucleic acid is predictive of the presence of activity in the corresponding polypeptide encoded from the full-length or wild type nucleic acid.

TABLE 32

| Sub-clone number | Wild-Type Clone |
| --- | --- |
| SEQ ID NO: 460 | SEQ ID NO: 120 |
| SEQ ID NO: 474 | SEQ ID NO: 108 |
| SEQ ID NO: 476 | SEQ ID NO: 300 |

Example 15

Analysis of Racemase Candidates Provided as PCR Products First Group

Racemases SEQ ID NO:314, SEQ ID NO:326, SEQ ID NO:342, SEQ ID NO:344, SEQ ID NO:318, SEQ ID NO:330, SEQ ID NO:328, SEQ ID NO:346, SEQ ID NO:334, and SEQ ID NO:352 were provided as PCR products with Nde I and Not I restriction sites at the 5' and 3' ends, respectively. The PCR fragments were cloned into pCR-Blunt II-Topo (Invitrogen, Carlsbad, Calif.) as recommended by the manufacturer. The sequence was verified by sequencing (Agencourt, Beverly, Mass.) and an insert with the correct sequence was then released from the vector using Nde I and Not I restriction enzymes and ligated into the Nde I and Not I restriction sites of pET30a. One skilled in the art can synthesize the genes encoding these racemases using various published techniques for example, as described in Stemmer et al., supra.

pET30a constructs of all racemase candidates listed above were transformed into the E. coli expression host BL21DE3. Liquid cultures were grown overnight in LB medium (BD Diagnostics, Franklin Lakes, N.J.) containing 50 µg/ml kanamycin at 37° C. with agitation at 250 rpm. These overnight cultures were used to inoculate shake flasks containing 50 mL Overnight Express™ media (Solutions 1-6, Novagen/EMD Biosciences, San Diego, Calif.) containing 50 µg/ml kanamycin. Overnight Express™ cultures were grown at 30° C. with agitation at 250 rpm for approximately 20 hours, and cells were harvested by centrifugation when $OD_{600}$ reached ~6-10.

Cell extracts were typically prepared from the above frozen pellets by adding 5 ml per g of cell pellet of Bugbuster Amine Free (Novagen/EMD Biosciences, San Diego, Calif.) with 5 µL/mL of Protease Inhibitor Cocktail II (Calbiochem, San Diego, Calif.) and 1 µl/ml of benzonase nuclease (Novagen/EMD Biosciences, San Diego, Calif.). Cell solutions were incubated at room temperature with gentle mixing for 15 min; cells were spun out at 14000 rpm for 20 min (at 4° C.) and the supernatant was carefully removed. Detergents and low molecular weight molecules were removed by passage through PD-10 columns (GE Healthcare, Piscataway, N.J.) previously equilibrated with 100 mM potassium phosphate (pH 7.8) with 0.05 mM PLP. Proteins were eluted with 3.5 mL of the same buffer. Total protein concentration was determined using the Pierce BCA protein assay with bovine serum albumin (BSA) as the standard, per the manufacturer's instructions (Pierce Biotechnology, Inc., Rockford, Ill.). The resulting cell-free extract was used for subsequent assays.

Desalted cell-free extracts were evaluated using tryptophan racemase assays under the conditions described in Example 17, with purified SEQ ID NO:442 serving as a positive control. For the tryptophan racemase assay, a total of 10 µg and 100 µg BAR equivalent SEQ ID NO:442 racemase (based on Pierce BCA total protein analysis with BSA as the standard and estimation of percentage of BAR protein expressed from Experion, (Experion, version A.01.10, Bio-rad, Hercules, Calif.)), were used as positive controls. 1 mg of total protein was added for each BD racemase candidate being tested (based on Pierce BCA total protein analysis with BSA as the standard). Formation of D-tryptophan was measured at 30 minutes, 1 hour, 2 hours, and 4 hours as described in Example 18. In a follow up experiment, a 24-hour sample was evaluated for D-tryptophan production.

None of the racemases listed above showed detectable tryptophan racemase activity at 24 hours under the conditions described herein. Tryptophan racemase activity was seen for positive control SEQ ID NO:442. The host organisms, expression conditions, and post expression cell handling can all affect whether there is detectable tryptophan racemase activity under the conditions of the assay. Additionally, under optimized conditions, it is expected that all racemase candidates could have tryptophan racemase activity.

Second Group

Racemases SEQ ID NO:322, SEQ ID NO:324 and SEQ ID NO:348 were provided as PCR products with Nde I and Not I restriction sites at the 5' and 3' ends, respectively. However all of these sequences had additional Nde I and/or Not I sites internal to the gene sequence so direct subcloning was not possible. SEQ ID NO:350 was re-amplified by PCR with RTth polymerase (Applied Biosystems, Foster City, Calif.) and primers adding an Nde I and Xho I restriction site at the 5' and 3' ends, respectively.

| Designation | Sequence | SEQ ID NO: |
|---|---|---|
| SEQ ID NO: 324 infusion F NdeI | TAAGAAGGAGATATACATATGGAATTC GATTGGATTCG | 517 |
| SEQ ID NO: 324 infusion R NotI | GGTGGTGGTGCTCGAGTGCGGCCGCTT ATAACACCTG | 518 |
| SEQ ID NO: 348 infusion F NdeI | TAAGAAGGAGATATACATATGTCGCAT TCCACCACCTGG | 519 |
| SEQ ID NO: 348 infusion R NotI | GGTGGTGGTGCTCGAGTGCGGCCGCTC AGCGATACTG | 520 |
| SEQ ID NO: 322 infusion F NdeI | TAAGAAGGAGATATACATATGAAAAGT GCAGGCATTATA G | 521 |
| SEQ ID NO: 322 infusion R NotI | GGTGGTGGTGCTCGAGTGCGGCCGCTT AAGCCTTAGT | 522 |

The PCR fragment was digested with Nde I and Xho I restriction enzymes and ligated into the Nde I and Xho I restriction sites of pET30a. Correct plasmids were verified by digestion with Nde I and Xho I and sequencing (Agencourt, Beverly, Mass.). One skilled in the art can synthesize the genes encoding these racemases using various published techniques for example, as described in Stemmer et al., supra.

pET30a clones of all of the above racemases were transformed into expression host BL21DE3. Liquid cultures were grown overnight (LB kanamycin 50, 37° C., 250 rpm) and used to inoculate shake flasks containing 50 mL Overnight Express™ media (Solutions 1-6, Novagen/EMD Biosciences, San Diego, Calif.) containing kanamycin. Overnight Express™ cultures were grown at 30° C. and 250 rpm for approximately 20 hours, and collected when the OD$_{600}$ reached ~6-10. Cells were harvested by centrifugation.

Desalted cell-free extracts of racemase candidates SEQ ID NO:322, SEQ ID NO:324, and SEQ ID NO:348 were prepared as described above.

Tryptophan racemase assays were carried out under the conditions described in Example 17, with purified *A. caviae* D76N BAR (see Example 19) serving as a positive control. For the tryptophan racemase assay, a total of 50 µg BAR equivalent of positive control (based on Pierce BCA total protein analysis with BSA as the standard and estimation of percentage of BAR protein expressed from Experion (Experion, version A.01.10, Biorad, Hercules, Calif.) was added. 1 mg of total protein was added for each BD racemase candidate being tested (based on Pierce BCA total protein analysis with BSA as the standard). Formation of D-tryptophan was measured at 1 hour, 2 hours, 4 hours, and 21.5 hours as described in Example 18.

TABLE 33

| | D-trp production | | | |
|---|---|---|---|---|
| | D-trp production, µg/mL | | | |
| Enzyme | 1 hour | 2 hours | 4 hours | 21.5 hours |
| *A. caviae* D76N pure | 742.7 | 1368 | 2160.7 | 2458.7 |
| SEQ ID NO: 322 | 305 | 437.7 | 596 | 1174.3 |
| SEQ ID NO: 324 | nd | nd | nd | nd |
| SEQ ID NO: 348 | nd | nd | nd | nd | nd = not detected under the conditions of the assay as described above.

Tryptophan racemase activity was observed for SEQ ID NO:322. This enzyme is interesting because it is the smallest racemase protein that was active on tryptophan, with the protein being only 232 amino acids (as compared to 409 amino acids for the *A. caviae* benchmark, and >300 amino acids for most of the other racemase candidates).

There was no detectable tryptophan racemase activity observed for SEQ ID NO:324 and SEQ ID NO:348 under the conditions tested. SDS-PAGE analysis showed good soluble protein expression for SEQ ID NO:348, but minimal soluble protein expression for SEQ ID NO:324. The host organisms, expression conditions, and post expression cell handling can all affect whether there is detectable tryptophan racemase activity under the conditions of the assay. Additionally, under optimized conditions, it is expected that all racemase candidates could have tryptophan racemase activity.

Third Group

Racemases SEQ ID NO:340 and SEQ ID NO:350 were provided as PCR products with Nde I and Not I restriction sites at the 5' and 3' ends, respectively. However, all of these sequences had additional Nde I and/or Not I sites internal to the gene sequence so direct subcloning was not carried out. SEQ ID NO:350 was re-amplified by PCR with RTth polymerase (Applied Biosystems, Foster City, Calif.) and primers adding an Nde I and Xho I restriction site at the 5' and 3' ends, respectively.

| Designation | Sequences | SEQ ID NO: |
|---|---|---|
| SEQ ID NO: 350 FNdeI | GGTTCCAACATATGACCGGGCTGACG GTAACGGCGGTG | 523 |
| SEQ ID NO: 350 RXhoI | GGTTCCAACTCGAGATAATAGCGGCCG CTCATCCC | 524 |
| SEQ ID NO: 340 infusion F NdeI | TAAGAAGGAGATATACATATGAGACCA GCTCGCGTTAGC | 525 |
| SEQ ID NO: 340 infusion R NotI | GGTGGTGGTGCTCGAGTGCGGCCGCCT AGTTCCAGTT | 526 |

The PCR fragment was digested with Nde I and Xho I restriction enzymes and ligated into the Nde I and Xho I restriction sites of pET30a. Correct plasmids were verified by digestion with Nde I and Xho I and sequencing (Agencourt, Beverly, Mass.). One skilled in the art can synthesize the genes encoding these racemases using various published techniques for example, as described in Stemmer et al., supra.

pET30a constructs of all racemase candidates listed above were transformed into the *E. coli* expression host BL21DE3. Liquid cultures were grown overnight in LB medium (BD Diagnostics, Franklin Lakes, N.J.) containing 50 µg/ml kanamycin at 37° C. with agitation at 250 rpm. These overnight cultures were used to inoculate shake flasks containing 50 mL Overnight Express™ media (Solutions 1-6, Novagen/EMD Biosciences, San Diego, Calif.) containing 50 µg/ml kanamycin. Overnight Express™ cultures were grown at 30° C., with agitation at 250 rpm for approximately 20 hours, and cells were harvested by centrifugation when $OD_{600}$ reached ~6-10.

Desalted cell-free extracts of racemase candidates SEQ ID NO:340 and SEQ ID NO:350 were prepared as described above.

Tryptophan racemase assays were carried out under the conditions described in Example 17, with SEQ ID NO:412 serving as a positive control.

For the tryptophan racemase assay, a total of ~5 µg BAR equivalent of control (based on Pierce BCA total protein analysis with BSA as the standard and estimation of percentage of BAR protein expressed from Experion, (Experion, version A.01.10, Biorad, Hercules, Calif.) was added, and 1 mg of total protein was added for each racemase candidate being tested (based on Pierce BCA total protein analysis with BSA as the standard). Formation of D-tryptophan was measured at 15 minutes, 2 hours, and 21 hours as described in Example 18.

No tryptophan racemization was detected for SEQ ID NO:340 or SEQ ID NO:350 under the conditions tested. Positive control SEQ ID NO:412 showed tryptophan racemase activity. SDS-PAGE analysis showed low soluble protein expression for SEQ ID NO:340 and SEQ ID NO:350. The host organisms, expression conditions, and post expression cell handling can all affect whether there is detectable tryptophan racemase activity under the conditions of the assay. Additionally, under optimized conditions, it is expected that all racemase candidates could have tryptophan racemase activity.

Example 16

Analysis of Racemases Provided as PCR-4-Blunt TOPO Clones

Racemases SEQ ID NO:336, SEQ ID NO:338, SEQ ID NO:358, SEQ ID NO:360, SEQ ID NO:362, and SEQ ID NO:366 were provided as PCR-4-Blunt TOPO clones. Racemases in these plasmids were amplified with RTth polymerase (Applied Biosystems, Foster City, Calif.) and primers adding an Nde I and Xho I restriction site at the 5' and 3' ends, respectively.

| Clone | Sequence | SEQ ID NO: |
|---|---|---|
| SEQ ID NO: 336FNdel | GGTTCCAAGGCATATGAGAACGAGACATCG ATGCTG | 527 |
| SEQ ID NO: 336RXhol | GGTTCCAATTCTCGAGTCAGGCTGCGTGAC TGCCGCGA | 528 |
| SEQ ID NO: 338FNdel | TTCCAATTGGCATATGCACCGCGTCTGGGCT GAAATC | 529 |
| SEQ ID NO: 338RXhol | GGTTCCAACTCGAGTCACACATACACACGCG CCACGC | 530 |
| SEQ ID NO: 356FNdel | TTGGAACCTTCATATGCAAACGAAACCCGC GCCCCG | 531 |
| SEQ ID NO: 356RXhol | GGTTCCAAGGCTCGAGTTAGCGAATGTAAA CCCGTTCCAC | 532 |
| SEQ ID NO: 358FNdel* | CCTTGGAACATATGGAACGAATCGTCCAGA AGCTGC | 533 |
| SEQ ID NO: 358RXhol* | GGCCTTAACTCGAGTTATGACATCCGCGGA ATCC | 534 |
| SEQ ID NO: 360FNdel* | CCTTGGAACATATGGAACGAATCGTCCAGA AGCTGC | 535 |
| SEQ ID NO: 360RXhol* | GGCCTTAACTCGAGTTATGACATCCGCGGA ATCC | 536 |
| SEQ ID NO: 362FNdel* | CCTTGGAACATATGGAACGAATCGTCCAGA AGCTGC | 537 |
| SEQ ID NO: 362RXhol* | GGCCTTAACTCGAGTTATGACATCCGCGGA ATCC | 538 |
| SEQ ID NO: 366FNdel* | CCTTGGAACATATGGAACGAATCGTCCAGA AGCTGC | 539 |
| SEQ ID NO: 366RXhol* | GGCCTTAACTCGAGTTATGACATCCGCGGA ATCC | 540 |

*Same forward and reverse primer pair was used for SEQ ID NO: 358, SEQ ID NO: 360, SEQ ID NO: 362, and SEQ ID NO: 366 due to 100% DNA homology in primer regions.

The PCR fragments were cloned into pCR-Blunt II-Topo (Invitrogen, Carlsbad, Calif.) as recommended by the manufacturer. The sequence was verified by sequencing (Agencourt, Beverly, Mass.) and an insert with the correct sequence was then released from the vector using Nde I and Xho I restriction enzymes (New England Biolabs, Ipswich, Mass.) and ligated into the Nde I and Xho I restriction sites of pET30a. See Table above for specific primers and plasmids names. (It is noted that the TOPO cloning efforts for SEQ ID NO:356 were unsuccessful after multiple attempts, so this racemase was not further processed). One skilled in the art can synthesize the genes encoding these racemases using various published techniques for example, as described in Stemmer et al., supra.

pET30a constructs of all racemase candidates listed above were transformed into the *E. coli* expression host BL21DE3. Liquid cultures were grown overnight in LB medium (BD Diagnostics, Franklin Lakes, N.J.) containing 50 µg/ml kanamycin at 37° C. with agitation at 250 rpm. These overnight cultures were used to inoculate shake flasks containing 50 mL Overnight Express™ media (Solutions 1-6, Novagen/EMD Biosciences, San Diego, Calif.) containing 50 µg/ml kanamycin. Overnight Express™ cultures were grown at 30° C. with agitation at 250 rpm for approximately 20 hours, and cells were harvested by centrifugation when $OD_{600}$ reached ~6-10.

Desalted cell-free extracts of batch 8 racemases SEQ ID NO:336, SEQ ID NO:338, SEQ ID NO:358, SEQ ID NO:360, SEQ ID NO:362, and SEQ ID NO:366 were prepared as described below (SEQ ID NO:356 and SEQ ID NO:364 from this experiment were not characterized).

Cell extracts were typically prepared from the above frozen pellets by adding 5 ml per g of cell pellet of Bugbuster Amine Free (Novagen/EMD Biosciences, San Diego, Calif.) with 5 µL/mL of Protease Inhibitor Cocktail II (Calbiochem, San Diego, Calif.) and 1 µl/ml of benzonase nuclease (Novagen/EMD Biosciences, San Diego, Calif.). Cell solutions were incubated at room temperature with gentle mixing for 15 min; cells were spun out at 14000 rpm for 20 min (at 4° C.) and the supernatant was carefully removed. Detergents and low molecular weight molecules were removed by passage through PD-10 columns (GE Healthcare, Piscataway, N.J.) previously equilibrated with 100 mM potassium phosphate (pH 7.8) with 0.05 mM PLP. Proteins were eluted with 3.5 mL of the same buffer. Total protein concentration was determined using the Pierce BCA (Pierce Biotechnology, Inc., Rockford, Ill.) protein assay with bovine serum albumin (BSA) as the standard, per the manufacturer's instructions. The resulting cell-free extract was used for subsequent assays.

Tryptophan racemase assays were carried out under the conditions described in Example 17, with purified *A. caviae* D76N BAR (Example 19) serving as a positive control. A total of 100 µg BAR equivalent of control was added (based on Pierce BCA total protein analysis with BSA as the standard and estimation of percentage of BAR protein expressed from Experion, version A.01.10, Biorad, Hercules, Calif.), and 1 mg of total protein was added for each racemase candidate being tested. Formation of D-tryptophan was measured at 30 minutes, 2 hours, 4 hours and 52 hours as described in Example 18.

TABLE 34

D-trp production
D-tryptophan production, µg/mL

| Enzyme | 30 min | 2 hours | 4 hours | 52 hours |
|---|---|---|---|---|
| SEQ ID NO: 336 | 1485 | 2787 | 2705 | 2434 |
| SEQ ID NO: 338 | 1503 | 2757 | 2738 | 2353 |
| SEQ ID NO: 366 | nd | nd | nd | nd |
| SEQ ID NO: 358 | nd | nd | nd | 27 |
| SEQ ID NO: 360 | nd | nd | nd | nd |
| SEQ ID NO: 362 | nd | nd | nd | nd |
| SEQ ID NO: 442 purified - 100 µg | 340 | 1020 | 1726 | 3011 |
| *A. caviae* D76N purified - 100 µg | 1036 | 2804 | 2849 | 3011 | nd = not detected under the conditions of the assay as described above.

Racemase candidates SEQ ID NO:336, SEQ ID NO:338 and SEQ ID NO:358 were active. Racemase candidates SEQ ID NO:366, SEQ ID NO:360, and SEQ ID NO:362 showed no detectable tryptophan racemase activity under the conditions tested. SEQ ID NO:366, SEQ ID NO:360, and SEQ ID NO:362 all had satisfactory soluble protein expression. The host organisms, expression conditions, and post expression cell handling can all affect whether there is detectable tryptophan racemase activity under the conditions of the assay. Additionally, under optimized conditions, it is expected that all racemase candidates could have tryptophan racemase activity.

Example 17

Description of Racemase Assay Conditions

Leucine, Phenylalanine, Tryptophan, Methionine, Tyrosine, Alanine, Lysine, Aspartic Acid, Glutamate Racemase Assay Racemase assays were performed starting with the L-amino acid isomer and the formation of corresponding D-amino acid was followed.

Assay Conditions:

30 mM L-amino acid (L-Leucine, L-Phenylalanine, L-Tryptophan, L-Methionine, L-Tyrosine, L-Alanine, L-Lysine, L-Aspartic Acid, or L-Glutamate), 50 mM Potassium phosphate buffer (pH 8.0), 0.05 mM PLP, and water was added to make the volume up to 1 mL.

The assays were conducted at 30° C. with shaking at 225 rpm. Desalted racemase candidate proteins (cell-free extracts or purified preparations) were evaluated for amino acid racemase activity. Wherever possible, appropriate negative and positive controls were included for the assays. Sample aliquots were taken for analysis at various timepoints and formic acid was added to a final concentration of 2% to stop the reaction. Samples were frozen at −80° C., then thawed, centrifuged and filtered through 0.2µ filter (Pall Life Sciences, Ann Arbor, Mich.). Samples were analyzed for D-amino acid using the chiral LC/MS/MS method described in Example 18.

Monatin Racemase Assay

A subset of racemase candidates that gave promising tryptophan racemase results was tested for monatin racemization.
Assay Conditions:

10 mM R,R monatin, 50 mM Potassium phosphate buffer (pH 8.0), 0.05 mM PLP, and water were added to make the volume up to 1 mL.

The assays were performed at 30° C. with shaking at 225 rpm. At various time points, sample aliquots were taken, diluted five-fold with distilled water, then filtered through 0.2µ filter (Pall Life Sciences, Ann Arbor, Mich.) and stored at −80° C. for subsequent analysis. Samples were analyzed for the distribution of monatin stereoisomers as described in Example 18.

Example 18

Detection of Monatin Stereoisomers and Chiral Detection of Lysine, Alanine, Methionine, Tyrosine, Leucine, Phenylalanine, Tryptophan, Glutamate, and Aspartate This example describes methods used to detect the presence of stereoisomers of monatin, lysine, alanine, methionine, tyrosine, leucine, phenylalanine, tryptophan, glutamate, and aspartate. It also describes a method for the separation and detection of the four stereoisomers of monatin.

Chiral LC/MS/MS ("MRM") Measurement of Monatin

Determination of the stereoisomer distribution of monatin in in vitro reactions was accomplished by derivatization with 1-fluoro-2-4-dinitrophenyl-5-L-alanine amide ("FDAA"), followed by reversed-phase LC/MS/MS MRM measurement.

Derivatization of Monatin with FDAA

To 50 µL of sample or standard and 10 µL of internal standard was added 100 µL of a 1% solution of FDAA in acetone. Twenty 4 of 1.0 M sodium bicarbonate was added, and the mixture incubated for 1 h at 40° C. with occasional mixing. The sample was removed and cooled, and neutralized with 20 µL of 2.0 M HCl (more HCl may be required to effect neutralization of a buffered biological mixture). After degassing was complete, samples were ready for analysis by LC/MS/MS.

LC/MS/MS Multiple Reaction Monitoring for the Determination of the Stereoisomer Distribution of Monatin Analyses were performed using the LC/MS/MS instrumentation described above. LC separations capable of separating all four stereoisomers of monatin (specifically FDAA-monatin) were performed on a Phenomenex Luna 2.0×250 mm (3 µm) C18 (2) reversed phase chromatography column at 40° C. The LC mobile phase consisted of A) water containing 0.05% (mass/volume) ammonium acetate and B) acetonitrile. The elution was isocratic at 13% B, 0-2 min, linear from 13% B to 30% B, 2-15 min, linear from 30% B to 80% B, 15-16 min, isocratic at 80% B 16-21 min, and linear from 80% B to 13% B, 21-22 min, with an 8 min re-equilibration period between runs. The flow rate was 0.23 mL/min, and PDA absorbance was monitored from 200 nm to 400 nm. All parameters of the ESI-MS were optimized and selected based on generation of deprotonated molecular ions ([M-H]—) of FDAA-monatin, and production of characteristic fragment ions.

The following instrumental parameters were used for LC/MS analysis of monatin in the negative ion ESI/MS mode: Capillary: 3.0 kV; Cone: 40 V; Hex 1: 15 V; Aperture: 0.1 V; Hex 2: 0.1 V; Source temperature: 120° C.; Desolvation temperature: 350° C.; Desolvation gas: 662 L/h; Cone gas: 42 L/h; Low mass resolution (Q1): 14.0; High mass resolution (Q1): 15.0; Ion energy: 0.5; Entrance: 0V; Collision Energy: 20; Exit: 0V; Low mass resolution (Q2): 15; High mass resolution (Q2): 14; Ion energy (Q2): 2.0; Multiplier: 650. Three FDAA-monatin-specific parent-to daughter transitions are used to specifically detect FDAA-monatin in in vitro and in vivo reactions. The transitions monitored for monatin are 542.97 to 267.94, 542.97 to 499.07, and 542.97 to 525.04. Monatin internal standard derivative mass transition monitored was 548.2 to 530.2. Identification of FDAA-monatin stereoisomers is based on chromatographic retention time as compared to purified synthetic monatin stereoisomers, and mass spectral data. An internal standard was used to monitor the progress of the reaction and for confirmation of retention time of the S,S stereoisomer.

Detection of L- and D-Amino Acids by LC/MS/MS

Samples containing a mixture of L- and D-amino acids such as lysine, alanine, methionine, tyrosine, leucine, phenylalanine, tryptophan, glutamate, and aspartate from biochemical reaction experiments were first treated with formic acid to denature protein. The sample was then centrifuged and filtered through a 0.2 µm nylon syringe filter prior to LC/MS/MS analysis. Identification of L- and D-amino acids was based on retention time and mass selective detection. LC separation was accomplished by using Waters 2690 liquid chromatography system and an ASTEC 2.1 mm×250 mm Chirobiotic TAG chromatography column with column temperature set at 45° C. LC mobile phase A and B were 0.25% acetic acid and 0.25% acetic acid in methanol, respectively. Isocratic elution was used for all methods to separate the L and D isomers. Lysine was eluted using 80% mobile phase A, and 20% B and a flow rate of 0.25 mL/min. Glutamate, alanine, and methionine were separated with elution of 60% mobile phase A and 40% B and a flow rate of 0.25 mL/min. Aspartate, tryptophan, tyrosine, leucine, and phenylalanine were separated isomerically with 30% mobile phase A and 70% B with a flow rate of 0.3 mL/min for aspartate and tryptophan, and 0.25 mL/min for tyrosine, leucine, and phenylalanine.

The detection system for analysis of L- and D-amino acids included a Waters 996 Photo-Diode Array (PDA) detector and a Micromass Quattro Ultima triple quadrupole mass spectrometer. The PDA, scanning from 195 to 350 nm, was placed in series between the chromatography system and the mass spectrometer. Parameters for the MICROMASS QUATTRO ULTIMA™ triple quadrupole mass spectrometer operating in positive electrospray ionization mode (+ESI) were set as the following: Capillary: 3.2 kV; Cone: 20 V; Hex 1: 12 V; Aperture: 0.1 V; Hex 2: 0.2V; Source temperature: 120° C.; Desolvation temperature: 350° C.; Desolvation gas: 641 L/h; Cone gas: 39 L/h; Low mass Q1 resolution: 16.0; High mass Q1 resolution: 16.0; Ion energy 1: 0.1; Entrance: −5; Collision: 20; Exit 1: 10; Low mass Q2 resolution: 16.0; High mass Q2 resolution: 16.0 Ion energy 2: 1.0; Multiplier: 650 V. MS/MS experiments with Multiple Reaction Monitoring (MRM) mode were set up to selectively monitor reaction transitions of 147.8 to 84.03, 147.8 to 56.3, and 147.8 to 102.2 for glutamate, 133.85 to 74.03, 133.85 to 69.94 and 133.85 to 87.99 for aspartate, 146.89 to 84.09, 146.89 to 55.97 and 146.89 to 67.23 for lysine, 149.80 to 56.1, 149.8 to 61.01, and 149.80 to 104.15 for methionine, 181.95 to 135.97, 181.95 to 90.88 and 181.95 to 118.87 for tyrosine, 131.81 to 86.04 and 131.81 to 69.31 for leucine, 90.0 to 44.3 for alanine, and 165.83 to 102.96, 165.83 to 93.27 and 165.83 to 120.06 for phenylalanine. In the case where numerous transitions are listed, the first transition listed was used for quantification. For tryptophan, MS/MS experiments with Multiple Reaction Monitoring (MRM) mode were set up to selectively monitor reaction transitions of 205.0 to 145.91, 205.0 to 117.92, and 205.0 to 188.05, and the transition from 212.0 to 150.98 for d8-DL tryptophan. Tryptophan quantification was achieved by determining the ratio of analyte response of transition 205.0 to 145.91 to that of the internal standard, d8-D,L tryptophan.

Production of Monatin for Standards and for Assays

A racemic mixture of R,R and S,S monatin was synthetically produced as described in U.S. Pat. No. 5,128,482.

The R,R and S,S monatin were separated by a derivatization and hydrolysis step. Briefly, the monatin racemic mixture was esterified, the free amino group was blocked with Cbz, a lactone was formed, and the S,S lactone was selectively hydrolyzed using an immobilized protease enzyme. The monatin can also be separated as described in Bassoli et al., 2005, *Eur. J. Org. Chem.*, 8:1652-1658.

Example 19

Cloning and Analysis of Broad Activity Racemase (BAR) from *Aeromonas Caviae* ATCC 14486

Since tryptophan racemase activity was detected in crude extracts from *Aeromonas caviae* ATCC 14486, degenerate primers were designed (based on conserved regions of known BAR homologs) to obtain the BAR gene from *Aeromonas caviae* ATCC 14486. Degenerate primer sequences are shown below:

Aer deg F2: 5'-GCCAGCAACGARGARGCMCGCGT-3' (SEQ ID NO:541); and

Aer deg R1: 5'-TGGCCSTKGATCAGCACA-3' (SEQ ID NO:542)

wherein K indicates G or T, R indicates A or G, S indicates C or G, and M indicates A or C.

The above primers were used to PCR amplify a 715 bp DNA fragment from *A. caviae* (ATCC Accession No. 14486) genomic DNA. The following PCR protocol was used: A 50 µL reaction contained 0.5 µL template (~100 ng of *A. caviae* genomic DNA), 1.6 µM of each primer, 0.3 mM each dNTP, 10 U rTth Polymerase XL (Applied Biosystems, Foster City, Calif.), 1×XL buffer, 1 mM Mg(OAc)$_2$ and 2.5 µL dimethyl sulfoxide. The thermocycler program used included a hot start at 94° C. for 3 minutes and 30 repetitions of the following steps: 94° C. for 30 seconds, 53° C. for 30 seconds, and 68° C. for 2 minutes. After the 30 repetitions, the sample was maintained at 68° C. for 7 minutes and then stored at 4° C. This PCR protocol produced a product of 715 bp.

The PCR product was gel purified from 0.8% TAE-agarose gel using the Qiagen gel extraction kit (Qiagen, Valencia, Calif.). The product was TOPO cloned and transformed into TOP10 cells according to manufacturer's protocol (Invitrogen, Carlsbad, Calif.). The plasmid DNA was purified from the resulting transformants using the Qiagen spin miniprep kit (Qiagen, Valencia, Calif.) and screened for the correct inserts by restriction digest with EcoR 1. The sequences of plasmids appearing to have the correct insert were verified by dideoxy chain termination DNA sequencing with universal M13 forward primers.

Four libraries were constructed for each strain as per manufacturer's protocols (BD GenomeWalker™ Universal Kit, Clontech). Gene-specific primers were designed as per GenomeWalker™ manufacturer's protocols based on sequences obtained using degenerate primer sequences (see above), allowing for a few hundred homologous base pair overlap with original product. These gene-specific primers were subsequently used with GenomeWalker™ adaptor primers for PCR of upstream and downstream sequences to complete A. caviae BAR ORF.

Full-Length Gene Sequence of the A. Caviae Bar Gene

```
                                   (SED ID NO: 543)
atgcacaaga aaacactgct cgcgaccctg atctttggcc tgctggccgg ccaggcagtc gccgccccct atctgccgct cgccgacgac caccgcaacg gtcaggaaca gaccgccgcc aacgcctggc tggaagtgga tctcggcgcg ttcgagcaca acatccagac cctgaagaat cgcctcggtg acaagggccc gcagatctgc gccatcatga aggcggacgc ctacggtcac ggcatcgacc tgctggtccc ttccgtggtc aaggcaggca tcccctgcat cggcatcgcc agcaacgaag aagcacgtgt tgcccgcgag aagggcttcg aaggtcgcct gatgcgggta cgtgccgcca ccccggatga agtggagcag gccctgccct acaagctgga ggagctcatc ggcagcctgg agagcgccaa ggggatcgcc gacatcgccc agcgccatca caccaacatc ccggtgcaca tcggcctgaa ctccgccggc atgagccgca acggcatcga tctgcgccag gacgatgcca aggccgatgc cctggccatg ctcaagctca aggggatcac cccggtcggc atcatgaccc acttcccggt ggaggagaaa gaggacgtca agctggggct ggcccagttc aagctggact accagtggct catcgacgcc ggcaagctgg atcgcagcaa gctcaccatc cacgccgcca actccttcgc cacctggaa gtaccggaag cctactttga catggtgcgc ccgggcggca tcatctatgg cgacaccatt ccctcctaca ccgagtacaa gaaggtgatg gcgttcaaga cccaggtcgc ctccgtcaac cactaccggg cgggcaacac cgtcggctat gaccgcacct tcaccctcaa gcgcgactcc ctgctggcca acctgccgat gggctactcc gacggctacc gccgcgccat gagcaacaag gcctatgtgc tgatccatgg ccagaaggcc cccgtcgtgg gcaagacttc catgaacacc accatggtgg acgtcaccga catcaagggg atcaaacccg gtgacgaggt ggtcctgttc ggacgccagg gtgatgccga ggtgaaacaa tctgatctgg aggagtacaa cggtgccctc ttggcggaca tgtacaccgt ctggggctat accaacccca agaagatcaa gcgctaa.
```

The Corresponding Amino Acid Sequence for the A. Caviae Native Bar

```
                                        (SEQ ID NO: 544)
MHKKTLLATL IFGLLAGQAV AAPYLPLADD HRNGQEQTAA

NAWLEVDLGA FEHNIQTLKN RLGDKGPQIC AIMKADAYGH

GIDLLVPSVV KAGIPCIGIA SNEEARVARE KGFEGRLMRV

RAATPDEVEQ ALPYKLEELI GSLESAKGIA DIAQRHHTNI

PVHIGLNSAG MSRNGIDLRQ DDAKADALAM LKLKGITPVG

IMTHFPVEEK EDVKLGLAQF KLDYQWLIDA GKLDRSKLTI

HAANSFATLE VPEAYFDMVR PGGIIYGDTI PSYTEYKKVM

AFKTQVASVN HYPAGNTVGY DRTFTLKRDS LLANLPMGYS

DGYRRAMSNK AYVLIHGQKA PVVGKTSMNT TMVDVTDIKG

IKPGDEVVLF GRQGDAEVKQ SDLEEYNGAL LADMYTVWGY

TNPKKIKR.
```

The following PCR primers were utilized to clone the native full-length A. caviae BAR in both tagged and C-terminally his-tagged versions:

```
                                        (SEQ ID NO: 545)
A. caviae F NdeI 5'-GGA ACC TTC ATA TGC ACA AGA
AAA CAC TGC TCG CGA CC-3';

(SEQ ID NO: 546)
A. caviae R BamH1 (untagged) 5'-GGT TCC AAG GAT
CCT TAG CGC TTG ATC TTC TTG GGG TTG-3';
and (SEQ ID NO: 547)
A. caviae R XhoI (C-term tag) 5'-TTC CAA GGC TCG
AGG CGC TTG ATC TTC TTG GGG TTG GTA-3'.
```

The C-terminally tagged enzyme had comparable activity to the untagged native A. caviae BAR. When 200 μg of purified (tagged) racemase enzymes were used in a tryptophan racemase assay as described in Example 17, at 30 minutes, A. caviae BAR produced 1034 μg/mL of D-tryptophan.

The first 21 N-terminal amino acid residues of the A. caviae native BAR amino acid sequence above (SEQ ID NO:544) were predicted to be a signal peptide using the program Signal P 3.0 ((cbs.dtu.dk/services/SignalP/on the World Wide Web). The following N-terminal primer was used to clone the A. caviae gene without amino acids 2-21 of the leader sequence: A.cavMinus leader F NdeI 5' CCT TGG AAC ATA TGG CCC CCT ATC TGC CGC T 3' (SEQ ID NO:548).

The leaderless racemase, when expressed, was found to retain approximately 65% of the activity, as compared with the expression product of the full-length gene. The periplasmic and cytoplasmic protein fractions were isolated for the wild type expression products, as well as the leaderless constructs, as described in the pET System Manual (Novagen, Madison, Wis.). The majority of expressed wildtype BAR was found in the periplasm, while the leaderless BAR appeared to remain in the cytoplasm. The reduction in activity of the leaderless A. caviae BAR may be due to a change in processing and/or folding when expressed in the cytoplasm.

Effect of Leader Sequence on Racemase

A D76N mutant of A. caviae BAR was made to determine if this position was critical for broad activity. Mutagenesis was done using the QuickChange-Multi site-directed mutagenesis kit (Stratagene, La Jolla, Calif.), using the C-tagged *A. caviae* BAR gene in pET30 as template. The following mutagenic primer was used to make a D76N change (nucleotide position 226): 5'-CGC CAT CAT GAA GGC GAA CGC CTA CGG TCA CG-3' (SEQ ID NO:549). The site-directed mutagenesis was done as described in the manufacturer's protocol. The mutant and the wildtype enzyme were produced as described above and assayed as described in Example 17 using 200 micrograms of purified protein (prepared as described herein—purified *A. caviae* D76N was C-term His tagged in pET30) and approximately 7 mg/mL of L-tryptophan as substrate. At the 30 minute time point, the mutant produced 1929 micrograms per mL of D-tryptophan as compared to 1149 micrograms per mL for the wildtype enzyme. The D76N mutant also reached equilibrium at an earlier time point. The improvement in activity was unexpected.

Based on the high homology in this region for *Aeromonas* and *Pseudomonas* BAR enzymes, it might be expected that similar mutations in other broad activity racemases would also be beneficial. A benefit effect, however, was not observed when a similar mutation in SEQ ID NO:442 was generated. See Example 13.

The following racemase candidates had 99% identity at the amino acid level to the BAR from *A. caviae* described in this example: SEQ ID NO:200, SEQ ID NO:202, SEQ ID NO:206, SEQ ID NO:142, SEQ ID NO:186 and SEQ ID NO:176. SEQ ID NO:176 had 97% identity at the amino acid level to the BAR from *A. caviae* described in this example. It is expected that these candidates would also have tryptophan racemase activity given the high sequence homology to an enzyme with demonstrated tryptophan racemase activity.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (549 sequences)

SEQ ID NO: 1 - DNA, 687 bp, Aquifex aeolicus
atgaacgcctgtgagaggttatcccgcgtccttgagagaattcagaaagcctgcgagagagcgggaaggggtgagaactgtgcgaaacttctaggagcttctaagaccgtacctccagaagttataagggagttttataactgcggactgaaggtttacggagaaaacagggttcaggagttcctcaaaaagtatgaagccctaaaagatttagacttagagtggcacttcatagggagactccagacgaataaagtgaagtaccttatgggtaaagtcgtcttaatccactcccttgacaggaagaacctcgcggacgaaatacaaaaaagagcctttaaaaacaacatagttcaggacgttttaatagaggtaaacgtgggaggcgaagaaacgaagggaggagtagagcccgagaacttaaaggaactctttgagtacactttagaacttcccaatgtaaaggttctcggactcatgaccatacctccgtatcttgaaaatcccgaagatgtcagaccttacttcagaaaactcagggaactgagggacgagctccaaagggagtacaacgttgcacttcctcacctctccatgggaatgtcccacgactttgaggttgcgattgaagagggtgcaactatcgtgagaataggcactttgctcttcggggagaggaagtattga

SEQ ID NO: 2 - protein, 228 aa, Aquifex aeolicus
  DOMAIN (2)...(228): Alanine racemase, N-terminal domain
  SITE (76)...(90): Uncharacterized protein family UPF0001 signature. Prosite id = PS01211
MNACERLSRVLERIQKACERAGRGENCAKLLGASKTVPPEVIREFYNCGLKVYGENRVQEFLKKYEALKDLDLEWHFIGRLQTNKVKYLMGKVVLIHSLDRKNLADEIQKRAFKNNIVQDVLIEVNVGGEETKGGVEPENLKELFEYTLELPNVKVLGLMTIPPYLENPEDVRPYFRKLRELRDELQREYNVALPHLSMGMSHDFEVAIEEGATIVRIGTLLFGERKY

SEQ ID NO: 3 - DNA, 1017 bp, Aquifex aeolicus
atgcccagagctattctggagataaacagtgaaaggataagacacaacgtcaagaagttatcggagttttccgggaaaaaggttatagcggttataaaggcggacgcctacggtataggttctatacaaatggcaaaaatactagagcctattgaagaagtggacgctttcgcggtagcctgcgttgaagagggggttgaactcaggaaaatgggaataaaaaaggaaatactcatactgggaggagtactgaaggatgaagtccctttagtagaggagtacttccttacccccgttgtttcggatattgagcacctgagagctataggaaacagggatataaagtttcacgtaaagtacgacacgggaatgggaagacttgggtttttgaacgaagttatacacgacccgagggtggaagggataatgagtcacctctcgagcccggcggacgaagaattttccaaactccagataaagaagtttgaggagatagttaagaagtacacaaaagttgagaaaatccacatggagagttcagcaggtgttgtgtacagagtgccttttaccactcacataagggtagggcttgcaatgtacggcgaaaaacccctgaagaattaccccgttgatataaaacccgcactcactcttaaagctaagttaatatccgtaaaggaacttcctgaaaattatccggtatcttacagcaggacgtacgtaactaagaaaaaaacgaaaacaggtgtagttgccttcgggtacgcggacggactcatgaaaacactgtccaacaggagttatttgctttataagggagaaaagctaccaattttcgggaacattaccatggacatgacaatagtggacctgaaaaatacggacgcaaaggtaggggattgggtttacgtggtaaacgaagaaagaacctttacggaacttgcaagagaagcgggaacgataccctatgagctcatgtgcaacttatcaaaaaggattaaaagagtcgtagtgtag

SEQ ID NO: 4 - protein, 338 aa, Aquifex aeolicus
  DOMAIN (3)...(205): Alanine racemase, N-terminal domain
  DOMAIN (215)...(338): Alanine racemase, C-terminal domain
  SITE (30)...(40): Alanine racemase pyridoxal-phosphate attachment site. Prosite id = PS00395
  SITE (269)...(272): N-glycosylation site. Prosite id = PS00001
  SITE (285)...(288): N-glycosylation site. Prosite id = PS00001
  SITE (333)...(336): N-glycosylation site. Prosite id = PS00001
MPRAILEINSERIRHNVKKLSEFSGKKVIAVIKADAYGIGSIQMAKILEPIEEVDAFAVACVEEGVELRKMGIKKEILILGGVLKDEVPLVEEYFLTPVVSDIEHLRAIGNRDIKFHVKYDTGMGRLGFLNEVIHDPRVEGIMSHLSSPADEEFSKLQIKKFEEIVKKYTKVEKIHMESSAGVVYRVPFTTHIRVGLAMYGEKPLKNYPVDIKPALTLKAKLISVKELPENYPVSYSRTYVTKKKTKTGVVAFGYADGLMKTLSNRSYLLYKGEKLPIFGNITMDMTIVDLKNTDAKVGDWVYVVNEERTFTELAREAGTIPYELMCNLSKRIKRVVV

SEQ ID NO: 5 - DNA, 720 bp, Unknown
  Bacterial DNA
atgacggaccgcacgtcggaactcgccgagaacctggcccgggtggaggagcgcatcgccgcggcctgtgccgccgccgggcgcgcgcgggaggaggtgacgctcatcgtggtcaccaagacctaccccgcgagcgacgtgagaatcctccacgggctcggcgtgcggaacgtcgccgagaaccgggaccaggacgccgcccccaaggcggcggcctgtgccgaccttgatctgacctggcacttcgtgggtcagttgcagaccaacaaggtcagatccgtggtgggttatgccgatgtggtgcagtccgtcgaccgcttgaagctcgtttcctcgctctccgccgcggcggagaaggagggccgggagctcggctgcctcctgcaggtcgcgctcgacgccgagtccggcgagcggggcgaccgcggcggtgtcgcaccggacgggatcgaggagttggcggccgccgtcgacgcggctcccgggctgcggctcgacggactgatgaccgtcgccccgctcgccggaccgtacgccgggcggcaacgcgccgccttcgaccggctgatggatttgtcgactgccctgcgcgcgacccgtccggctgcgaacatggtgtcagcagggatgagtgcggacctcgaagaggccgtcgctgccggggcgacacacgtacgcgtcggtacggcggtactcggtgtccgcccgaagctcgggtaa

SEQ ID NO: 6 - protein, 239 aa, Unknown
  Bacterial protein
  DOMAIN (5)...(237): Alanine racemase, N-terminal domain
  SITE (81)...(95): Uncharacterized protein family UPF0001 signature. Prosite id = PS01211
MTDRTSELAENLARVEERIAAACAAAGRAREEVTLIVVTKTYPASDVRILHGLGVRNVAENRDQDAAPKAAACADLDLTWHFVGQLQTNKVRSVVGYADVVQSVDRLKLVSSLSAAAEKEGRELGCLLQVALDAESGERGDRGGVAPDGIEELAAAVDAAPGLRLDGLMTVAPLAGPYAGRQRAAFDRLMDLSTALRATRPAANMVSAGMSADLEEAVAAGATHVRVGTAVLGVRPKLG

SEQ ID NO: 7 - DNA, 1032 bp, Unknown
  Bacterial DNA
atggcgctctccctctacgtcgacaccgctcgctggcgcgcgcaccagaagaccgtcatcgaccagttccccggcgtgatcccggtctgcaagggcaacggctacggcttcggccacgagcgcctcgcggacgaggcggcgcggttcggtgccgacatgctggccgtgggcaccacgtacgaggccgcgaagatcaaggactggttcagcggcgacctgctggtcctcaccccgttccgccggggtgaggaaccggttccgctgcccgaccgggtcatccgctccgtgtcgtccgtggacggcgtccacgccctcgtgggcgcccgggtcgtcatcgagtgcatgagctcgatgaagcggcacggcgtccgcgaggaggagctcccgcagctccactcggccatcgaggacgtccgcctcgaaggcttcgcgctgcacctgcccctggaccgcccggacggcacggacgccgtcgaggaggtcatcggctggatggaccggctgcgggccgcccggctgccgctgcacaccatgttcgtcagccacctgcgggcggaggagcaggccaggctccagcagcagttcccgcagacccgcttccgcgcccggatcggcacccggctgtggctgggcgaccacgaggccacggagtaccggggtgcggtcctcgacgtgacccgggtcgccaagggcgaccgcttcggctaccgccagcagaaggccgcttcggacggctggctggtcgtcgtcgccggcggtacctcgcacggcgtcggcctggaggctcccaaggcgatgcacggcgtcatgccgcgtgccaagggcgtcgcgcgggccggtctcgccaccgtcaaccgcaacctctcgccgttcgtgtgggccggcaagcagcgctggttcgccgagccgccgcatatgcaggtgtcgatcctgttcgtgccgtccgacgcgcaggagccccgggtcggcgacgaactggtggcccatctgcggcacacgacgacgcagttcgaccggctcgtggagcgctga

SEQ ID NO: 8 - protein, 343 aa, Unknown
  Bacterial protein
  DOMAIN (2)...(216): Alanine racemase, N-terminal domain
  SITE (253)...(263): Regulator of chromosome condensation (RCC1) signature 2. Prosite id = PS00626
MALSLYVDTARWRAHQKTVIDQFPGVIPVCKGNGYGFGHERLADEAARFGADMLAVGTTYEAAKIKDWFSGDLLVLTPFRRGEEPVPLPDRVIRSVSSVDGVHALVGARVVIECMSSMKRHGVREEELPQLHSAIEDVRLEGFALHLPLDRPDGTDAVEEVIGWMDRLRAARLPLHTMFVSHLRAEEQARLQQQFPQTRFRARIGTRLWLGDHEATEYRGAVLDVTRVAKGDRFGYRQQKAASDGWLVVVAGGTSHGVGLEAPKAMHGVMPRAKGVARAGLATVNRNLSPFVWAGKQRWFAEPPHMQVSILFVPSDAQEPRVGDELVAHLRHTTTQFDRLVER

SEQ ID NO: 9 - DNA, 1149 bp, Unknown
  Bacterial DNA
atgactgagacaccgccgccccgcagagcccgcgccgagatcgacctcggcgcgctgcgtgcgaacgtccgcacgctgcgcgcccgcgtcgccccccacgtccggatcatggccgtggtcaaggccgacgcgtacggacacggcgcggtgcgctgtgcccgcgccgccctggacgcgggcgcggactggctcggcacggccaccccgcacgaggcgctcgcgctgcgcgccgccgggatcacggacgtccccgtcatgtgctggctctggacccccggcgacccctgggaccagggcatcgaggccggtctcgacatgtccgtgagcgggatgtgggccctggaggaggtcgtgcgggccgcgcgggccaccggtggtgtcgcccgtgtgcagctcaaggccgacaccgggctcgggcgcaacggctgccagcccgccgactggcccgagctcgtcggtgaggcgctgaaggccgaggccgaggggctggtcgaggtcaccgggctctggtcgcacttcgcgtgcgccgacgagccccaccacccctccatcgccgcccagctcgacgtgttccgctcgatgctcgactacgccgagaaggccggcgtccggccggaggtccggcacatcgccaactccccggccaccctcaccctccctgaggctcatttcgacctggtccgtcccggtatcgccatgtacggcgtctcgccgagcccggagctgggcacctccgccgagctcgggctgcggcccgtgatgtcgctcaaggcgagcgtcgccctggtgaagcgggtcccggccgggcacggcgtcagctacggccaccactacgtcaccgacgcggagacgaccctcggtctcgtcccgctcggctacgccgacggcgtcccccggcacgcctcgggccgcggccccgtcctcgtcgacggcaccgtcaggaccgtcgccgggcgggtcgccatggaccagttcgtcgtcgacctcggcggggacgtccccgcgccggggaccgaggccgtgctcttcgggcccggcgacctgggcgagcccaccgcggaggactgggcggtggccgccgacaccatcgcgtacgagatcgtgacccggatcggcgcgcgcgtcccgcgcgtgtacctgggcgaatag

SEQ ID NO: 10 - protein, 382 aa, Unknown
  Bacterial DNA
  DOMAIN (9)...(239): Alanine racemase, N-terminal domain
  DOMAIN (253)...(380): Alanine racemase, C-terminal domain
  SITE (38)...(48): Alanine racemase pyridoxal-phosphate attachment site. Prosite id = PS00395
MTETPPPRRARAEIDLGALRANVRTLRARVAPHVRIMAVVKADAYGHGAVRCARAALDAGADWLGTATPHEALALRAAGITDVPVMCWLWTPGDPWDQGIEAGLDMSVSGMWALEEVVRAARATGGVARVQLKADTGLGRNGCQPADWPELVGEALKAEAEGLVEVTGLWSHFACADEPHHPSIAAQLDVFRSMLDYAEKAGVRPEVRHIANSPATLTLPEAHFDLVRPGIAMYGVSPSPELGTSAELGLRPVMSLKASVALVKRVPAGHGVSYGHHYVTDAETTLGLVPLGYADGVPRHASGRGPVLVDGTVRTVAGRVAMDQFVVDLGGDVPAPGTEAVLFGPGDLGEPTAEDWAVAADTIAYEIVTRIGARVPRVYLGE

SEQ ID NO: 11 - DNA, 1122 bp, Unknown
  Obtained from environmental sample
gtgcgcgacggcctccaccatgcaggcgcaacgcttaccgtcgacctcggcgccattcgcgccaactatcgcctgctccgccgccggctcggcgcgaccgcctgtgccgccgtcgtcaaggccgatgcctacggtctcggcgcggcggcggtcgcgccggcgctcgcacgcgaggggtgccggcagttcttcgtggcgcacctcgacgaggcgctcgcgctccgcccgctgctgccggaggccgaggtcttcgtgctgaacgggcttccggcaggcgccgaggctgagtgcgcggctcatcgggtgacgccggtcctgaacagcctcgcccagctcgacgcctgggcggcccatggccggcgcctcggccgggcgctgcccgcggcgctccaggtcgacagcggcatgtcgcggctcggcctcggcgaggccgaggtcgatgtgctcgcagaaagtccgcggcggctcgaaggcatcgggctccggctcgtcatgagccatctcgcctgcgccgagcggcaggaccacccgatgaaccgggagcagcttcgccgcttcgaggccgcgcgggcgcggctgccgaaggcgcccgcgagcctcgccaactcctccggcatcttcctcgggccggacttccacttcgacctggcccggcccggcgcggcgctctacggcctcgccccggtggcgggcgaggcgaacccgatgcggccggtcgtccgcctgcacggccggatcgtgcaggtccgcgaggtcgccgccggcgcggcggtcggctacggcgcgagctggcgagcggacgggccgcggcgcatcgccaccgtcgcggtcggctacgccgacggctacctgcgcagcctctccggccgcgccaccgccttttccggcgaggcacccgtgccgctggtcggcatcgtctcgatggacaccgcgaccttcgacgtcaccgacgcccccgcggcggtcgggggcggcttcctggagctgatcgggccgcgcaacccggtcgacgcgctcgccgcccaggccggcaccatcggctacgagatcctcacctcgctcggccaccgctacgcccgcgcctatgcggacgccgaccagcccgaaaggctcacggcatga

SEQ ID NO: 12 - protein, 373 aa, Unknown
  Obtained from environmental sample
  DOMAIN (9)...(229): Alanine racemase, N-terminal domain
  DOMAIN (239)...(363): Alanine racemase, C-terminal domain
  SITE (37)...(47): Alanine racemase pyridoxal-phosphate attachment site. Prosite id = PS00395
  SITE (205)...(208): N-glycosylation site. Prosite id = PS00001
MRDGLHHAGATLTVDLGAIRANYRLLRRRLGATACAAVVKADAYGLGAAAVAPALAREGCRQFFVAHLDEALALRPLLPEAEVFVLNGLPAGAEAECAAHRVTPVLNSLAQLDAWAAHGRRLGRALPAALQVDSGMSRLGLGEAEVDVLAESPRRLEGIGLRLVMSHLACAERQDHPMNREQLRRFEAARARLPKAPASLANSSGIFLGPDFHFDLARPGAALYGLAPVAGEANPMRPVVRLHGRIVQVREVAAGAAVGYGASWRADGPRRIATVAVGYADGYLRSLSGRATAFSGEAPVPLVGIVSMDTATFDVTDAPAAVGGGFLELIGPRNPVDALAAQAGTIGYEILTSLGHRYARAYADADQPERLTA

SEQ ID NO: 13 - DNA, 1065 bp, Unknown
  Obtained from environmental sample
atgagacccgcccgcgcccgtatcgccctcgatgcgctccgtcacaactacctcctcaccaggcagcaccatggacgccgcgcgcttgccgttatcaaggccaacgcctacggccacggcgcagtgcggtgcgcgcgtgcgctggaagatatcgccgacggtttcgcagtcgccatcgtcgaagaggcgatacagctccgggaggctggcattcgtggtccaatcctggtcctcgagggcatattcgatggcgatgacctcgccctcgcactacaacatcgcttatggctggtagtgcatcacgaggcgcagttgcgtttgctcgaggcggcgcgaatccctgacggcgccagcctcgacatctggctcaagctcaacaccggaatgaaccgtgctgggttcgaacctggcgaataccgggcggcatggcaacgcctgcgcacctgccggggagtgaacgacatcgtgctgatgactcatctgtcgcaggcggacgaaccccaggccggggcgacgatgcgccagatcgcactgttcgatgccaccaccagcggtgtcccaggtgagcgcagtatcgcgaactcggccggacttcttggatggagtgctgctcgtcgcgactgggggcggcccggcatttcgctctacggggccgatccaatgccgggcgaatccgccggtttgcgccctgtcatgaccctcgagagcgagatcatggcggtgcgtgacgtaccctccggagccgccattggctacggcgcgcgtttccgggcgcagcgcccgacacgcatcggactggtggcgatgggttacgccgatggctatccgcgcagcgccgccgacggcacgccggttctggtccacggtgcccgtagccggctgatcgggcgggtttccatggacatgctcacggtggatctcaccgatgtgcccgaggccgggctcggtagccgggtcgagctttgggggccgaacatatccatcaacgacgtcgcgcagggcgccggcaccattgcctacgagttgctgtgcaacgtcaaacgggtacgagtgctttacgattga

SEQ ID NO: 14 - protein, 354 aa, Unknown
  Obtained from environmental sample
  DOMAIN (3)...(221): Alanine racemase, N-terminal domain
  DOMAIN (231)...(354): Alanine racemase, C-terminal domain
  SITE (30)...(40): Alanine racemase pyridoxal-phosphate attachment site. Prosite id = PS00395
MRPARARIALDALRHNYLLTRQHHGRRALAVIKANAYGHGAVRCARALEDIADGFAVAIVEEAIQLREAGIRGPILVLEGIFDGDDLALALQHRLWLVVHHEAQLRLLEAARIPDGASLDIWLKLNTGMNRAGFEPGEYRAAWQRLRTCRGVNDIVLMTHLSQADEPQAGATMRQIALFDATTSGVPGERSIANSAGLLGWSAARRDWGRPGISLYGADPMPGESAGLRPVMTLESEIMAVRDVPSGAAIGYGARFRAQRPTRIGLVAMGYADGYPRSAADGTPVLVHGARSRLIGRVSMDMLTVDLTDVPEAGLGSRVELWGPNISINDVAQGAGTIAYELLCNVKRVRVLYD

SEQ ID NO: 15 - DNA, 702 bp, Unknown
  Obtained from environmental sample
atgaagacgatagggctgatcggcggcatgagctgggaatcgacccagacctactaccggctcatcaaccagggggtgaaggcgcggctgggcgggctgcactccgcccggctggtgctctacagcgtggacttcgccgagatcgaggcgctgcagcgccgcggcgactgggcggccacggcacagatcctcggcgcagcggcccgctccctggcggcggccggcgccgacttcctggtgctgtgcaccaacaccatgcacaaggtcgccccgcagctcgagcaggccgtcgagattccgctgctgcatatcgccgatgccaccgccaaggcgctgcaccggcagggcgtgacccgggtggggctgctcggcacccgcttcaccatggagcaggccttctaccgcgagcgcctggaagcgcacggcatcgaggtgttgattcccgatgccaaacagcgcgagcgggtgcacgccgtcatctacgacgagctctgccgcggtgagatccgcgcggattccagagctgagtaccttgagatcgtggcctcgctggccgggcagggcgcccagggcgtcatcctcggctgcacggagatcgggctgctgatccaggccgacgatacggacgttccgctcttcgacaccaccgccatccacgccgaacaggcggtggagaccgcactcgggaccccggcgtcgtag

SEQ ID NO: 16 - protein, 233 aa, Unknown
  Obtained from environmental sample
  DOMAIN (3)...(228): Asp/Glu/Hydantoin racemase
MKTIGLIGGMSWESTQTYYRLINQGVKARLGGLHSARLVLYSVDFAEIEALQRRGDWAATAQILGAAARSLAAAGADFLVLCTNTMHKVAPQLEQAVEIPLLHIADATAKALHRQGVTRVGLLGTRFTMEQAFYRERLEAHGIEVLIPDAKQRERVHAVIYDELCRGEIRADSRAEYLEIVASLAGQGAQGVILGCTEIGLLIQADDTDVPLFDTTAIHAEQAVETALGTPAS

SEQ ID NO: 17 - DNA, 807 bp, Unknown
  Obtained from environmental sample
atgagtaaaaattcacctatagggatttttgatagtggaataggcgggcttacagtagcttatgctgtaaaggaagctcttcccggagagagtctggtttattttggagatacggcccatttgccctatggggataaatctaccgctgccattcaatcctatgcagtaaaaatatgtgatgtcctgattcagaaaaaatgtaaagttattttaatagcctgtaactctgcatcctcagcggcatatcagcttgtaaaagaatatgtagggtcaaaagccaaagttattaatgtgatagacccggtaattaattgtttgagtgaaaattatcagaatgagatcataggattaataggcacaaaaaaaacggtcaattctaatgtttatcagaaaaaaatagacagacttaaggaaaacatcaccctcaaggcgcttgccacacctttacttgctcccatgatagaagagggctattttaataataccattagtgagcagattattcatacttatttaacagataaaaagcttaaaggtattaaagcattgattcttggatgtacacattaccctcttatcaaaaaggaaatagaggctttttatcagggaaaagtaagcgtaattgattcttcccgcattgttgcttcttatttaaagaaatacctggaatcaaaaaaactgcttaataatttgagttctcctggtcataaattttttgtatctgactatactcattcttttgcagaatctacaaagctatttttcagagaagaggtaaatctggagcattacccactttgggagtaa

SEQ ID NO: 18 - protein, 268 aa, Unknown
  Obtained from environmental sample
  DOMAIN (6)...(223): Asp/Glu/Hydantoin racemase
  SITE (141)...(144): N-glycosylation site. Prosite id = PS00001
  SITE (162)...(165): N-glycosylation site. Prosite id = PS00001
  SITE (185)...(195): Aspartate and glutamate racemases signature 2. Prosite id = PS00924
  SITE (233)...(236): N-glycosylation site. Prosite id = PS00001
MSKNSPIGIFDSGIGGLTVAYAVKEALPGESLVYFGDTAHLPYGDKSTAAIQSYAVKICDVLIQKKCKVILIACNSASSAAYQLVKEYVGSKAKVINVIDPVINCLSENYQNEIIGLIGTKKTVNSNVYQKKIDRLKENITLKALATPLLAPMIEEGYFNNTISEQIIHTYLTDKKLKGIKALILGCTHYPLIKKEIEAFYQGKVSVIDSSRIVASYLKKYLESKKLLNNLSSPGHKFFVSDYTHSFAESTKLFFREEVNLEHYPLWE

SEQ ID NO: 19 - DNA, 822 bp, Unknown
  Obtained from environmental sample
atgcccgacaaccgacccatcggcgtcttcgactcgggcattggcgggctcaccgtcgtccgcgagctgatccatcgcctgcccggcgagtccatcgtgtacttcggcgacacggcccgcgtcccgtacggcccgaaatcgccggagaccgtggcccgctactccgaggaggccgcggcgttcctcctcagccgcgacgtcaagctcatcgtcatcgcgtgcaacacggccacggcccacgccggtgagcggctggcagggcagctgtccgttcccgtcatcggcgtcatcgagcctggcgcccgcgccgccgtcagcgccacgcgcaccggccgggtgggcgtcatcggcacggcgggcaccatccgctccggcgcctacgacctggccgtgcgccaccgcctcgaggacgcccgcgtctacgcgcagccgtgcccgctcttcgtgccgctggtggaggaagggctggccgcccacgcggcggcccgcctcgtggcggaggactacctgcgtccgctgcaggagatggacgtggacgtcgtcatcctcggctgcacgcactaccccgtgctgcgcgaactgattgcagacattgtaggcgacgacgtgcgcctcgtggattccgccacggagaccgcgctggacgtggccgccaccctggaccgtctcgacctgcgcaggacgtcgctggagccgccgtcgtacaccttcgtggccagtgacgcgccgctccgcttccgcgatgtgggccgcgccttcgtcggcgacgtgttgcgtgacgtggagcacgtggatgtggaggggttcggccgcgcggcgtga

SEQ ID NO: 20 - protein, 273 aa, Unknown
  Obtained from environmental sample
  DOMAIN (6)...(221): Asp/Glu/Hydantoin racemase
  SITE (72)...(80): Aspartate and glutamate racemases signature 1. Prosite id = PS00923
  SITE (183)...(193): Aspartate and glutamate racemases signature 2. Prosite id = PS00924
MPDNRPIGVFDSGIGGLTVVRELIHRLPGESIVYFGDTARVPYGPKSPETVARYSEEAAAFLLSRDVKLIVIACNTATAHAGERLAGQLSVPVIGVIEPGARAAVSATRTGRVGVIGTAGTIRSGAYDLAVRHRLEDARVYAQPCPLFVPLVEEGLAAHAAARLVAEDYLRPLQEMDVDVVILGCTHYPVLRELIADIVGDDVRLVDSATETALDVAATLDRLDLRRTSLEPPSYTFVASDAPLRFRDVGRAFVGDVLRDVEHVDVEGFGRAA

SEQ ID NO: 21 - DNA, 768 bp, Unknown
  Obtained from environmental sample
atgctcgccccaccgggagccatacaggagagcatcgtgcgctcgaagccgcgcatcggctgcatcgtgccggcgatcaacgtggtcgccgaggaggacttcatcgcgctctgcccgccatgggccggggtgcatttcgcgcgcgccgacgtggcgctcgacgcgccgctgcgcgaacagctgctgggcatggtcgacgcggcaccggggctcgcccgctgcctcgccaaggccgatgtcggcgtcgtcgccttcgcctgcaccagcgccggcttcgccttcggccccggaaccggcgacgcgatcgggggcagaatgaccgcggcagcgggcgtgccctgcctcaccaccgcgagcgccgtggtcgaggccctgcgggcgctcggggtgcggtgcctcggcctcgccacaccctatgtcgagtgggtcgtggaggccgagcgggcgttcctcgaggcgcacggcttcgaggtatcggcgagcaacggcctcggcctcgaggcggggcgcgacatccacgcggtgccaccggagcgcgttcgggacctcgccctcgaggcggcgcacccggaggcggaggcgatcttcgtcagctgtaccgacctgcacgcgctggccctggtgcccgagctcgaggtcgcgaccgggcggccggtggtgaccagcaaccaggccaccttctgggcctgcgcgcgccggctcggcctgccgccgatcgagggccgcggcctgctgctcgcggaccatctggagcgggccgccgcatga

SEQ ID NO: 22 - protein, 255 aa, Unknown
  Obtained from environmental sample
  DOMAIN (18)...(235): Asp/Glu/Hydantoin racemase
MLAPPGAIQESIVRSKPRIGCIVPAINVVAEEDFIALCPPWAGVHFARADVALDAPLREQLLGMVDAAPGLARCLAKADVGVVAFACTSAGFAFGPGTGDAIGGRMTAAAGVPCLTTASAVVEALRALGVRCLGLATPYVEWVVEAERAFLEAHGFEVSASNGLGLEAGRDIHAVPPERVRDLALEAAHPEAEAIFVSCTDLHALALVPELEVATGRPVVTSNQATFWACARRLGLPPIEGRGLLLADHLERAAA

SEQ ID NO: 23 - DNA, 1080 bp, Unknown
  Obtained from environmental sample
atgcaagcggcaactgttgttattaaccgccgcgctctgcgacacaacctgcaacgtctgcgtgaactggcacccgccagcaagctcgttgcagtcgtgaaagcgaacgcttacggacacggtcttcttgagaccgcgcgaacgctccccgatgccgatgcttttggcgtcgcccgtcttgaagaagctctgcgcctgcgtgcaggcggaattacccagcctattttgctgctcgaaggcttctttgaagccagcgacctcaccaccattgccgaccagcacctgcataccgcggtccataacgaagagcagcttgccgcgctggaaaccgccgagctcagcgagccagtgaccgtttggatgaagctcgacaccgggatgcaccgtctgggcgtgcgcccggagaaggcggatgcgttttaccagcgcctgagtcagtgcaaaaacgtgcgccagccggtcaatatcgtcagccactttgcccgtgccgatgagccggaatgtggcgccacagagcaacagctcgatatcttcaacaccttctgtgaaggcaaaccaggaatgcgctctattgccgcatccggcggtattttgctctggccgcagtcgcatttcgactgggcacgtcctggcatcattctctatggcgtttcaccgctggacaacaaaccctgggggccggattttggcttccagccagtgatgtcgctggtgtctaacctgattgcggtgcgcgagcacaaagcgggcgagcctgtgggctacgggggaacctgggtcagcgagcgcgatacgcggcttggcgtggtggcgatggggtatggcgatggttatccacgcgctgcgccgtccggtacaccggtgctggtcaacggccgtgaagtgacaattgtcggtcgtgtggcaatggacatgatctgcgtggatttggggcctgacgccgaagataaagcgggcgattcggtagtgatgtggggcgaagggctgcccgttgaacgcatcgcagaaataacgaaagtaagtgcttacgaacttatcacgcggctcacctcaagggtagcgatgaaatacgtcgagtaa

SEQ ID NO: 24 - protein, 359 aa, Unknown
  Obtained from environmental sample
  DOMAIN (3)...(220): Alanine racemase, N-terminal domain
  DOMAIN (234)...(358): Alanine racemase, C-terminal domain
  SITE (31)...(41): Alanine racemase pyridoxal-phosphate attachment site. Prosite id = PS00395
MQAATVVINRRALRHNLQRLRELAPASKLVAVVKANAYGHGLLETARTLPDADAFGVARLEEALRLRAGGITQPILLLEGFFEASDLTTIADQHLHTAVHNEEQLAALETAELSEPVTVWMKLDTGMHRLGVRPEKADAFYQRLSQCKNVRQPVNIVSHFARADEPECGATEQQLDIFNTFCEGKPGMRSIAASGGILLWPQSHFDWARPGIILYGVSPLDNKPWGPDFGFQPVMSLVSNLIAVREHKAGEPVGYGGTWVSERDTRLGVVAMGYGDGYPRAAPSGTPVLVNGREVTIVGRVAMDMICVDLGPDAEDKAGDSVVMWGEGLPVERIAEITKVSAYELITRLTSRVAMKYVE

SEQ ID NO: 25 - DNA, 1080 bp, Unknown
  Obtained from environmental sample
atgcaagcggcaactgttgttattaaccgccgcgctctgcgacacaacctgcaacgtctgcgtgaactggcacccgccagcaagctcgttgcagtcgtgaaagcgaacgcttacggacacggtcttcttgagaccgcgcgaacgctccccgatgccgatgcttttggcgtcgcccgtcttgaagaagctctgcgcctgcgtgcaggcggaattacccagcccattctgctgcttgaaggtttctttgaagccagcgacctcaccaccattgccgaccagcacctgcataccgcggtccataacgaagagcagcttgccgcgctggaaaccgctgagctcagcgagccagtgaccgtgtggatgaagctcgacaccgggatgcaccgtctgggcgtgcgcccggagaaggcggatgcgttttatcagcgcctgtgtcagtgcaaaaacgtgcgccagccggtcaatatcgtcagccactttgcccgtgccgatgagccggaatgtggcgccactgagcaacaactcgatatcttcaacaccttctgtgaaggcaaaccaggaatgcgctctattgccgcatccggcggtattttgctctggccgcagtcgcatttcgactgggcacgccctggcatcattctctatggcgtttcaccgctggacaacaagccctgggggccggattttggcttccagccggtgatgtcgctggtatctaacctgattgcggtgcgtgagcacaaagcgggtgagcctgtgggatacggtggaacctgggtcagcgagcgggatacgcggcttggcgtggtggctatggggtatggcgatggttatccacgcgctgcgccgtccggtacaccggtgctggtcaacggtcgtgaagtgacaattgtcggtcgcgtggcaatggacatgatctgcgtggatttggggcctgacgccgaagataaagcaggcgattcggtagtgatgtggggcgaaggactgcccgttgaacgcatcgcagcaataacgaaagtaagtgcttacgaactgatcacgcggctcacctcaagggtagcgatgaaatacgtcgagtaa

SEQ ID NO: 26 - protein, 359 aa, Unknown
  Obtained from environmental sample
  DOMAIN (3)...(220): Alanine racemase, N-terminal domain
  DOMAIN (234)...(358): Alanine racemase, C-terminal domain
  SITE (31)...(41): Alanine racemase pyridoxal-phosphate attachment site. Prosite id = PS00395
MQAATVVINRRALRHNLQRLRELAPASKLVAVVKANAYGHGLLETARTLPDADAFGVARLEEALRLRAGGITQPILLLEGFFEASDLTTIADQHLHTAVHNEEQLAALETAELSEPVTVWMKLDTGMHRLGVRPEKADAFYQRLCQCKNVRQPVNIVSHFARADEPECGATEQQLDIFNTFCEGKPGMRSIAASGGILLWPQSHFDWARPGIILYGVSPLDNKPWGPDFGFQPVMSLVSNLIAVREHKAGEPVGYGGTWVSERDTRLGVVAMGYGDGYPRAAPSGTPVLVNGREVTIVGRVAMDMICVDLGPDAEDKAGDSVVMWGEGLPVERIAAITKVSAYELITRLTSRVAMKYVE

SEQ ID NO: 27 - DNA, 651 bp, Pelagibacter ubique
atgcataatacagttaaaaatttaatttatatagaagacctcgttaaatctaaagtaaatcatgttaaattgcctaaaattattgcagtatcaaagacttttccaatagaaaatattttaccattaattgagtatggccatcttcattttggagaaaataaagttcaagaagcccttgataagtgggttcacataaaaaatcaaaatccgagtattcagcttcatttaattggaagacttcaaaccaataaagtaaaagtagctttaagaatatttgattatattcatgcattggatagtgaaaaattagctaataaaattgctgatgaacaaactaaacaaggaaaaaaacctaagatatttattcaagtcaatattggtaacgaaaatcaaaaatctggaataaataaagaaagactgagtgatttttataaattttgcaaaaatttaaatttagatatcattggtacgatgtgtattccaccaaatgatgacaataccaaaaaatatttttctgagatgaatgaaataaaccaagaattagactttaaagagctaagtatgggcatgtcgggagattacttggaggctattagatataatgcaacatatgttagagttggctcaaaaatatttggtagtagaacttaa

SEQ ID NO: 28 - protein, 216 aa, Pelagibacter ubique
  DOMAIN (1)...(216): Alanine racemase, N-terminal domain
  SITE (204)...(207): N-glycosylation site. Prosite id = PS00001
MHNTVKNLIYIEDLVKSKVNHVKLPKIIAVSKTFPIENILPLIEYGHLHFGENKVQEALDKWVHIKNQNPSIQLHLIGRLQTNKVKVALRIFDYIHALDSEKLANKIADEQTKQGKKPKIFIQVNIGNENQKSGINKERLSDFYKFCKNLNLDIIGTMCIPPNDDNTKKYFSEMNEINQELDFKELSMGMSGDYLEAIRYNATYVRVGSKIFGSRT

SEQ ID NO: 29 - DNA, 1032 bp, Unknown
  Obtained from environmental sample
atgcgcacttccaaatccgtccaaatcatcaactgccatgccgaaggcgaagtgggcgatgtcattgtgggcggcgtggcgacacctcccggcgacacgatctgggagcagtcgcgtttcatcgccagcgaccagacgctgcgcaatttcgttttgaatgagccccgtggcggcgtctttcgccatgtgaacctgctggtgccgcccaagcaccccgatgcgcagatgggctttatcatcatggagccggaagacacgcctcccatgtcaggctcaaattgcatttgcgtggccaccgtcctgcttgatagcggcattatccccatggttgagcccgtgacgcacctgaagctggaagcacctgcgggcctcgttgaaatcaccgcccactgcagcaatggcaaggccaaccgcatcacgctgcgcaatgttccagccttcgctgaccgtttgcaggtgccgctggaaatcgaaggccatggaactattctcgtggataccgcctttggcggcgacagcttcgtcctggccgacgcaaaatcctttggcttcgaaatgctgccccacgaggcccgcgagatcgccgtcacgggccggaaaattgccgcagcggccaatgcgcagttgggtttttcccacccggcattgcccgactggaagcatttttccttttgcttcatgaccgggcctttggagcgcattgatggcatgctctccagccgcaatgcctgcgtggtgaagcccggcaagcttgaccgttcgcccaccggcaccggctgttccgccctcatggccgtgctccatgccaagggcataatgaaaaccggcgacagtttcatcggccgctcgatcatcgaaagccgctttgagggacgaattgaagccgaaaccgtagtgggcaatcaccgggtcatcatccccacgatttcgggctccgcctggatcaccggccagaccacgctgatgcttgatcccggcgacccctggcctgccggctataaaatcgccgatacctggcccaaagaaccatga

SEQ ID NO: 30 - protein, 343 aa, Unknown
  Obtained from environmental sample
  DOMAIN (9)...(334): Proline racemase
MRTSKSVQIINCHAEGEVGDVIVGGVATPPGDTIWEQSRFIASDQTLRNFVLNEPRGGVFRHVNLLVPPKHPDAQMGFIIMEPEDTPPMSGSNCICVATVLLDSGIIPMVEPVTHLKLEAPAGLVEITAHCSNGKANRITLRNVPAFADRLQVPLEIEGHGTILVDTAFGGDSFVLADAKSFGFEMLPHEAREIAVTGRKIAAAANAQLGFSHPALPDWKHFSFCFMTGPLERIDGMLSSRNACVVKPGKLDRSPTGTGCSALMAVLHAKGIMKTGDSFIGRSIIESRFEGRIEAETVVGNHRVIIPTISGSAWITGQTTLMLDPGDPWPAGYKIADTWPKEP

SEQ ID NO: 31 - DNA, 1011 bp, Unknown
  Obtained from environmental sample
gtgggaactgtttcgaacgtggtgggacaactggccgggagcgaaggcgtgagcggcaccacaggcatccgcgtgatcgactcgcacaccgagggtgagccgacgcgcgtcgtcatcgacggcggcccggatcttggagagggaactctctcggaaaggcgggagcggttccgccggtcgtttgacgacttccgccgtgcggtgatcctcgagccgcgcggctcggatgtgctggtcggggcgctgctgtgcgaaccggtcgatccctcgtgtgcagcgggggtgatcttcttcaacaacaccggctacctggggatgtgcggtcacggcgcgatgggggtggcagcgactttggcgcatctcggccggatcaacttcggcaggcatcgtctggagacgcctgtcggcgtcgtcgaggttgagttgcacgatccgcatcgcgtgagcgttgagaacgtgccgagctatcgctggcggagcggcgtctgcttcgaggtcgagtcgctggggaccgtcaccggcgatgtcgcgtggggcggcaactggttcttcctggtggagggttcgccgctgccgctccttccggagaacgcccgctcgctgacggacgccgctcagcagatcaggcaggcattgatcgcaaacgggatcgccggtgaggatggtgccgagatcgaccacatcgagctgttcgggccggcaggcgcccccgatgctcacggccgcaacttcgtgctctgtcccggcggtgcgtgggatcgctctccctgcgggaccgggacgagcgcgaagctggcctgcctggccgccgacggaaaactcgcacccgggcaggtgtgggtgcaggagagcctgatcggcagccggttctgggcgtcgtatcgtgaggcgtcggacgggaagatcatcccccgcatcaccggccgggcgtatgtgtgcggcgaggcgaccctgtttcgacatcccgatgacccgttccgtgacggaatctccatcgagggggcttcatga

SEQ ID NO: 32 - protein, 336 aa, Unknown
  Obtained from environmental sample
  DOMAIN (25)...(331): Proline racemase
  SITE (100)...(103): N-glycosylation site. Prosite id = PS00001
MGTVSNVVGQLAGSEGVSGTTGIRVIDSHTEGEPTRVVIDGGPDLGEGTLSERRERFRRSFDDFRRAVILEPRGSDVLVGALLCEPVDPSCAAGVIFFNNTGYLGMCGHGAMGVAATLAHLGRINFGRHRLETPVGVVEVELHDPHRVSVENVPSYRWRSGVCFEVESLGTVTGDVAWGGNWFFLVEGSPLPLLPENARSLTDAAQQIRQALIANGIAGEDGAEIDHIELFGPAGAPDAHGRNFVLCPGGAWDRSPCGTGTSAKLACLAADGKLAPGQVWVQESLIGSRFWASYREASDGKIIPRITGRAYVCGEATLFRHPDDPFRDGISIEGAS

SEQ ID NO: 33 - DNA, 1116 bp, Unknown
  Obtained from environmental sample
atgagcgccgcggcgctgcgcgcgggcgcgatcctgacggtggacctcgatgcggtcgttgcgaactggcggctgctgtcgaagctggcgaaaagggccgaatgcgccgccgtggtcaaggcggacgcctacggcctcggcgcggggcgggtcggcgctgcccttcagacggcgggttgcaggaccttcttcgtcgcccatctcgaggaaggactcgaactccggaaggcgatcggcttcagttcgcgtgtcttcgtcctgaacggcacacctgcgggcaccgaaagcgagttcctcaactcggtcctgatcccggtcgtcaacacgtcgggagaactcgccgcctggcgcgatcatgcccgggagaagagacgcagcatgcctgtcgccctccagctcgacacgggtatgtcgcgcctcgggctgtcgcccggcgacgtggccgagctggcgggagagccgtttagccttggcggcctctccgtcgagctggtcatgagccatctcgcctgtgccgacgcgccggcgcaccctgccaaccgacggcagcggcgcgcgttcgccaagctccggacggttctgcccaggcgggcggcatcttcgctcgcgaactccgccggagttctcctagggccggagttccgcttcgacctggttcggccgggagcggcgctctacgggatcaacccggtccccggaggtccgaaccccttcagccaggccgtgacgctatcggcgcgcgtgcttcagattcgcgaggtgccagccgggaccagcgtcggctatggccacgcacgtacggtggagagacaaggccgcctcgcgacgctctcgctcggctacgcggacggctggccacgtgccgcgaacatgtccgccttctacaaggggcaaccgctacccttcgcggggcgcgtatcgatggacagcatcgtcgtcgatgcgactgactgcgccgaggcccctcgcgagggcgagttcgtaagtctcatcactcgagaacagaccgtggacgatgtcgcccgtgccgccggcacgatcggctatgagatcctcacccggctcggccgacgctttgcccgagattaccgtcaccacgcagcgctcgctgcctga

SEQ ID NO: 34 - protein, 371 aa, Unknown
  Obtained from environmental sample
  DOMAIN (9)...(231): Alanine racemase, N-terminal domain
  DOMAIN (241)...(364): Alanine racemase, C-terminal domain
  SITE (37)...(47): Alanine racemase pyridoxal-phosphate attachment site. Prosite id = PS00395
  SITE (109)...(112): N-glycosylation site. Prosite id = PS00001
  SITE (294)...(297): N-glycosylation site. Prosite id = PS00001
MSAAALRAGAILTVDLDAVVANWRLLSKLAKRAECAAVVKADAYGLGAGRVGAALQTAGCRTFFVAHLEEGLELRKAIGFSSRVFVLNGTPAGTESEFLNSVLIPVVNTSGELAAWRDHAREKRRSMPVALQLDTGMSRLGLSPGDVAELAGEPFSLGGLSVELVMSHLACADAPAHPANRRQRRAFAKLRTVLPRRAASSLANSAGVLLGPEFRFDLVRPGAALYGINPVPGGPNPFSQAVTLSARVLQIREVPAGTSVGYGHARTVERQGRLATLSLGYADGWPRAANMSAFYKGQPLPFAGRVSMDSIVVDATDCAEAPREGEFVSLITREQTVDDVARAAGTIGYEILTRLGRRFARDYRHHAALAA

SEQ ID NO: 35 - DNA, 1101 bp, Unknown
  Obtained from environmental sample
atggagcattatcggccggcacccggcacaccgctcaaggacctggacacaccctgcttactcgttgacctcgatgctgttgagcacaactttcgcctcattgctgacacgtatcgggacacagtctgcaaaatgcgcacccatgtcaagaatctcaaaagtcccatcctggcacacatgcagatacgcgctgggggcacagtgggcggagtgtgtgctgccaaggtcgctgaggctgaggtcatggtcgaaggggggatcacggatgtcctgattgccaatcaggtggtggcgcgtgccaagatcgtgcggctctgttcgctggcaaagcgagctgatatgaaggtcggcattgacaacgctcaaaacctgcgtgccttgtcggaagtggcgcaggctcaaggcgttaccctgggggtgctgatcgaagtcgacacctcaatgcatcgtgctggcatcaggcgcatcgaagacggggtcgagttggccaaactggcggcaacgctgcctggtattgcctttcggggcctcatgagccaccagacgctccctgggcgccctgacaagcaaactcgcctgattgagggacggcggttcatgcagacgtgcttggatctcaaggaagccattgagggtgctggcattcccgtcgacattgtctcaactggtgagacctggacctacgacatcgctgccgatctgccaggcgtgaccgaaatccagggcggcacgtatgcgcttatgtctgcctcctatggctacatggacgagtttgctattgctgccaaagtccttggcacgattataagcacaccgcgccctggtgtcgccattggcgatgtgggggtacaggctttggcgtcgcctggtggcgtgttgccatccgtggagggtatgcctggggtgacggttgaggcgttgcacgatgagcatattgtgttacgcaccgatggcaccacaccactcaccatcggggaccagtttctcctgcacagcggccagcaggatattttagtgaatcgctgggatcagtatattgccgtgcgtcagggggtagtagaagcggtgtgggatatcccggcgcgtgggtgtcatcattaa

SEQ ID NO: 36 - protein, 366 aa, Unknown
  Obtained from environmental sample
  DOMAIN (17)...(247): Alanine racemase, N-terminal domain
MEHYRPAPGTPLKDLDTPCLLVDLDAVEHNFRLIADTYRDTVCKMRTHVKNLKSPILAHMQIRAGGTVGGVCAAKVAEAEVMVEGGITDVLIANQVVARAKIVRLCSLAKRADMKVGIDNAQNLRALSEVAQAQGVTLGVLIEVDTSMHRAGIRRIEDGVELAKLAATLPGIAFRGLMSHQTLPGRPDKQTRLIEGRRFMQTCLDLKEAIEGAGIPVDIVSTGETWTYDIAADLPGVTEIQGGTYALMSASYGYMDEFAIAAKVLGTIISTPRPGVAIGDVGVQALASPGGVLPSVEGMPGVTVEALHDEHIVLRTDGTTPLTIGDQFLLHSGQQDILVNRWDQYIAVRQGVVEAVWDIPARGCHH

SEQ ID NO: 37 - DNA, 489 bp, Unknown
  Obtained from environmental sample
agcgacctgctgcgtcccggtgccgctctgtatggcctttgcccgcagcccgacaagccgaatccgctgaagccggtggtgaccctgcgcggcaaggtgatccagacccgcgagctgccggctggcacgccggtcggctataatggccgctatgtctgccatgccaagggccgcatcgccacggtgggcgtcggctatgccgacggcttcctgcgctgcctgggcaacaaggcggtggcctcgatccgcggcaagctggtgccgatcgtcggcgctgtatccatggacctgatcaccctcgatatctcgggcctgaatttcgaccccgctcccggcgaactggtggacctgatcggcggcgaggcggaaagccccgatgccgtcgcggccaaggccggcaccatcggctatgaaatcctcaccagcctgggcgggcgttatttccgcagttatcagggcggcgaagccgccgccaacagcagcctttaa

SEQ ID NO: 38 - protein, 162 aa, Unknown
  Obtained from environmental sample
  DOMAIN (26)...(152): Alanine racemase, C-terminal domain
  SITE (161)...(164): N-glycosylation site. Prosite id = PS00001
SDLLRPGAALYGLCPQPDKPNPLKPVVTLRGKVIQTRELPAGTPVGYNGRYVCHAKGRIATVGVGYADGFLRCLGNKAVASIRGKLVPIVGAVSMDLITLDISGLNFDPAPGELVDLIGGEAESPDAVAAKAGTIGYEILTSLGGRYFRSYQGGEAAANSSL

SEQ ID NO: 39 - DNA, 372 bp, Unknown
  Obtained from environmental sample
gtgcaacatcgcatgaccggcgcaaatggcgccgaggtcgatcatatcgagttgttcgggccgccgactgcgcccggcgctgacagcaagaacttcgtgctctgccccggcggcgcgtacgatcgctcgccgtgcggcacgggcacgagcgcgaagctggcgtgcctggtggccgacggcaagctgcagccgggtcaaacctggcggcaggaggggatattgggcacggtgttcgaggcgaaggccgtcgtcgagagtgggcacgtcatcccctacatcaccggttcggcctatatcaccggcgaggcgacgctcttgatcgaccccgccgatccgtttcgggacggcatttcaacgggagcgcaagcgtga

SEQ ID NO: 40 - protein, 123 aa, Unknown
  Obtained from environmental sample
  DOMAIN (2)...(118): Proline racemase
MQHRMTGANGAEVDHIELFGPPTAPGADSKNFVLCPGGAYDRSPCGTGTSAKLACLVADGKLQPGQTWRQEGILGTVFEAKAVVESGHVIPYITGSAYITGEATLLIDPADPFRDGISTGAQA

SEQ ID NO: 41 - DNA, 1230 bp, Unknown
  Obtained from environmental sample
atgcccttttgccgtaccctcctggccgtatcgctgggcctgctgatcaccggccaggccccgctgtacgctgcgccaccgctgtcgatggacaacggcaccaacgccctgaccgtgcagaacagcaacgcctgggttgaagtcagcgccagcgctctgcaacacaacatccgcaccctgcagacagagttgggtggcaagtccaaactgtgcgccgtgctcaaggccgacgcctatggccacggcattggcctggtgatgccatcgatcattgcccagggcgtgccctgcgtggcggtggccagcaacgaagaggcccgcgtggttcgcgccagcggctttaccgggcaactggtgcgggtacgcctggccagcctcagcgagctggaagacgccctgcaatacgacatggaggaactggtcggcagcgccgagttcgcccgccaggtcgatgccatcgccgcgcgccacggcaagacgctgcgcatccacatggcgctcaactccagcggcatgagccgcaacggcgtagagatggccacctggtccggccgtggcgaagcgctgcagatcactgaccagaagcacctcaagctggtcgcgctgatgacccacttcgccgtggaagacaaggacgatgtgcgcaagggcctggcggcgttcaatgagcaggccgactggctgatcaagcacgccaagcttgaccgcagcaaggtcaccctgcacgcggccaactcgttcgctacgctggaggtgccggaagcgcgcctggacatggtgcgtaccggtggcgcgctgttcggtgacaccgtgccggcgcgcaccgaatacaaacgtgccatgcagttcaagtcgcacgtggcggcggtgcacagctacccggccggcaacaccgtcggctacgaccgcaccttcaccctggcccgcgattcgcgcctggccaacatcaccgtcggctactccgacggctaccgccgggtcttcaccaacaagggccatgtgctgatcaacggccatcgcgtgccggtggtgggcaaggtttcgatgaacacgctgatggtcgatgtcaccgacttcccggacgtgaagggtggcaacgaagtggtgctgtttggcaagcaggccgggtctgaaatcacccaggccgaaatggaagaaatcaacgatgcgctgctcgccgacctgtacaccgtgtggggcagtgccaacccgaaaattctcgtcgactga

SEQ ID NO: 42 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFCRTLLAVSLGLLITGQAPLYAAPPLSMDNGTNALTVQNSNAWVEVSASALQHNIRTLQTELGGKSKLCAVLKADAYGHGIGLVMPSIIAQGVPCVAVASNEEARVVRASGFTGQLVRVRLASLSELEDALQYDMEELVGSAEFARQVDAIAARHGKTLRIHMALNSSGMSRNGVEMATWSGRGEALQITDQKHLKLVALMTHFAVEDKDDVRKGLAAFNEQADWLIKHAKLDRSKVTLHAANSFATLEVPEARLDMVRTGGALFGDTVPARTEYKRAMQFKSHVAAVHSYPAGNTVGYDRTFTLARDSRLANITVGYSDGYRRVFTNKGHVLINGHRVPVVGKVSMNTLMVDVTDFPDVKGGNEVVLFGKQAGSEITQAEMEEINDALLADLYTVWGSANPKILVD

SEQ ID NO: 43 - DNA, 1230 bp, Unknown
  Obtained from environmental sample
atgcccttttgccgtacccttctggccgtatcgctgggcctgctgatcaccggccaggccccgctgtacgctgcgccaccgctgtcgatggacaacggcaccaacgccctgaccgtgcagaacagcaacgcctgggttgaagtcagcgccagcgctctgcaacacaacatccgcaccctgcagacagagttgggtggcaagtccaaactgtgcgccgtgctcaaggccgacgcctatggccacggcattggcctggtgatgccatcgatcattgcccagggcgtgccctgcgtggcggtggccagcaacgaagaggcccgcgtggttcgcgccagcggctttatcgggcaactggtgcgggtacgcctggccagcctcagcgagctggaagacgccctgcaatacgacatggaagaactggtcggcagcgccgagttcgcccgccaggtcgatgccatcgccgcgcgccacggcaagacgctgcgcatccacatggcgctcaactccagcggcatgagccgcaacggcgtagagatggccacctggtccggccgtggcgaagcgctgcagatcactgaccagaagcacctcaagctggtcgcgctgatgacccacttcgccgtggaagacaaggacgatgtgcgcaagggcctggcggcgttcaatgagcaggccgactggctgatcaagcacgccaagcttgaccgcagcaaggtcaccctgcacgcggccaactcgttcgctacgctggaggtgccggaagcgcgcctggacatggtgcgtaccggtggcgcgctgttcggtgacaccgtgccggcgcgcaccgaatacaaacgtgccatgcagttcaagtcgcacgtggcggcggtgcacagctacccggccggcaacaccgtcggctacgaccgcaccttcaccctggcccgcgattcgtgcctggccaacatcaccgtcggctactccgacggctgccgccgggtcctcaccaacaagggccatgtgctgatcaacggccatcgcgtgccggtggtgggcaaggtttcgatgaacacgctgatggtcgatgtcaccgacttcccggacgtgaagggtggcaacgaagtggtgctgtttggcaagcaggccgggtctgaaatcacccaggccgaaatggaagaaatcaacgatgcgctgctcgccgacctgtacaccgtgtggggcagtgccaacccgaaaattctcgtcgactga

SEQ ID NO: 44 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFCRTLLAVSLGLLITGQAPLYAAPPLSMDNGTNALTVQNSNAWVEVSASALQHNIRTLQTELGGKSKLCAVLKADAYGHGIGLVMPSIIAQGVPCVAVASNEEARVVRASGFIGQLVRVRLASLSELEDALQYDMEELVGSAEFARQVDAIAARHGKTLRIHMALNSSGMSRNGVEMATWSGRGEALQITDQKHLKLVALMTHFAVEDKDDVRKGLAAFNEQADWLIKHAKLDRSKVTLHAANSFATLEVPEARLDMVRTGGALFGDTVPARTEYKRAMQFKSHVAAVHSYPAGNTVGYDRTFTLARDSCLANITVGYSDGCRRVLTNKGHVLINGHRVPVVGKVSMNTLMVDVTDFPDVKGGNEVVLFGKQAGSEITQAEMEEINDALLADLYTVWGSANPKILVD

SEQ ID NO: 45 - DNA, 1230 bp, Unknown
  Obtained from environmental sample
atgccattttcccgtaccctcctggccgtatcgctgggcctgctgatcaccggccaggccccgctgtacgctgcgccaccgctgtcgatggacaacggcaccaacgccctgaccgtgcagaacagcaacgcctgggttgaagtcagcgccagcgctctgcaacacaacatccgcaccctgcagacagagttgggtggcaagtccaaactgtgcgccgtgctcaaggccgacgcctatggccacggcattggcctggtgatgccatcgatcattgcccagggcgtgccctgcgtggcggtggccagcaacgaagaggcccgcgtggttcgcgccagcggctttaccgggcaactggtgcgggtacgcctggccagcctcagcgagctggaagacgccctgcaatacgacatggaagaactggtcggcagcgccgagttcgcccgccaggtcgatgccatcgccgcgcgccacggcaagacgctgcgcatccacatggcgctcaactccagcggcatgagccgcaacggcgtagagatggccacctggtccggccgtggcgaagcgctgcagatcactgaccagaagcacctcaagctggtcgcgctgatgacccacttcgccgtggaagacaaggacgatgtgcgcaagggcctggcggcgttcaatgagcaggccgactggctgatcaagcacgccaagcttgaccgcagcaaggtcaccctgcacgcggccaactcgttcgctacgctggaggtgccggaagcgcgcctggacatggtgcgtaccggtggcgcgctgttcggtgacaccgtgccggcgcgcaccgaatacaaacgtgccatgcagttcaagtcgcacgtggcggcggtgcacagctacccggccggcaacaccgtcggctacgaccgcaccttcaccctggcccgcgattcgcgcctggccaacatcaccgtcggctactccgacggctaccgccgggtcttcaccaacaagggccatgtgctgatcaacggccatcgcgtgccggtggtgggcaaggtttcgatgaacacgctgatggtcgatgtcaccgacttcccggacgtgaagggtggcaacgaagtggtgctgtttggcaagcaggccgggtctgaaatcacccaggccgaaatggaagaaatcaacgatgcgctgctcgccgacctgtacaccgtgtggggcagtgccaacccgaaaattctcgtcgactga

SEQ ID NO: 46 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFSRTLLAVSLGLLITGQAPLYAAPPLSMDNGTNALTVQNSNAWVEVSASALQHNIRTLQTELGGKSKLCAVLKADAYGHGIGLVMPSIIAQGVPCVAVASNEEARVVRASGFTGQLVRVRLASLSELEDALQYDMEELVGSAEFARQVDAIAARHGKTLRIHMALNSSGMSRNGVEMATWSGRGEALQITDQKHLKLVALMTHFAVEDKDDVRKGLAAFNEQADWLIKHAKLDRSKVTLHAANSFATLEVPEARLDMVRTGGALFGDTVPARTEYKRAMQFKSHVAAVHSYPAGNTVGYDRTFTLARDSRLANITVGYSDGYRRVFTNKGHVLINGHRVPVVGKVSMNTLMVDVTDFPDVKGGNEVVLFGKQAGSEITQAEMEEINDALLADLYTVWGSANPKILVD

SEQ ID NO: 47 - DNA, 1230 bp, Unknown
  Obtained from environmental sample
atgccattctcccgtacacttctggccgtatcgctgggcctgctgatcaccggccaggccccgctgtacgctgcgccaccgctgtcgatggacaacggcaccaacgccctgaccgtgcagaacagcaacgcctgggttgaagtcagcgccagcgctctgcaacacaacatccgcaccctgcagacagagttgggtggcaagtccaaactgtgcgccgtgctcaaggccgacgcctatggccacggcatcggcctggtgatgccatcgatcattgcccagggcgtgccctgcgtggcggtggccagcaacgaagaggcccgcgtggttcgcgccagcggctttaccgggcaactggtgcgggtacgcctggccagcctcagcgagctggaagacgccctgcaatacgacatggaagaactggtcggcagcgccgagttcgcccgccaggtcgatgccatcgccgcgcgccacggcaagacgctgcgcatccacatggcgctcaactccagcggcatgagccgcaacggcgtagagatggccacctggtccggccgtggcgaagcgctgcagatcactgaccagaagcacctcaagctggtcgcgctgatgacccacttcgccgtggaagacaaggacgatgtgcgcaagggcctggcggcgttcaatgagcaggccgactggctgatcaagcacgccaagcttgaccgcagcaaggtcaccctgcacgcggccaactcgttcgctacgctggaggtgccggaagcgcgcctggacatggtgcgtaccggtggcgcgctgttcggtgacaccgtgccggcgcgcaccgaatacaaacgtgccatgcagttcaagtcgcacgtggcggcggtgcacagctacccggccggcaacaccgtcggctacgaccgcaccttcaccctggcccgcgattcgcgcctggccaacatcaccgtcggctactccgacggctaccgccgggtcttcaccaacaagggccatgtgctgatcaacggccatcgcgtgccggtggtgggcaaggtttcgatgaacacgctgatggtcgatgtcaccgacttcccggacgtgaagggtggcaacgaagtggtgctgtttggcaagcaggccgggtctgaaatcacccaggccgaaatggaagaaatcaacgatgcgctgctcgccgacctgtacaccgtgtggggcagtgccaacccgaaaattctcgtcgactga

SEQ ID NO: 48 - protein, 409 aa, Unknown; identical to SEQ ID NO: 46
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001

SEQ ID NO: 49 - DNA, 1230 bp, Unknown
  Obtained from environmental sample
atgccattctgccgtaccctactggctgcatccctggccctgctgatcactggccaggccccgctgtacgctgcgccaccgctgtcgatggacaacggcaccgacgccctgaccgtacagaacagcaacgcctgggtcgaagtcagcgccagcgccctgcaacacaacatccgcaccttgcaggccgagctgggcggcaagtccaggctgtgcgccgtgctcaaggccgacgcctatggccatggcatcggcctggtgatgccgtcgatcattgcccagggcgtgccctgcgtggcggtggccagcaacgaagaggcccgtgtggtccgcgccagcggctttaccgggcaactggtgcgggttcgcctggccagcctcagcgagctggaagacgccttgcagtacgacatggaagagctggtcggcagcgccgagttcgcccgccaggtcgatgccattgccgcacgccatggcaagaccctgcgcattcacatggcgctcaactcaagcggcatgagccgcaacggggtggagatgaccacttggtccggccgtggcgaagcgctgcagatcaccgatcagaaacacctcaagctggtcgcgctgatgacccactttgccgtggaggacaaggacgatgtgcgcaacggcctggcggcgttcaacgaacagaccgactggctgatcaagcacgcaaaacttgatcgcagcaagctcaccctgcacgcggccaactcgttcgctaccctggaggtgccggaagcgcgcctggacatggtgcgcaccggtggcgcgctgttcggcgacaccgtgccggcgcgcaccgagtaccagcgcgccatgcagttcaagtcgcacgtggcggcggtgcacagctacccggccggcaacaccgtcggctacgaccgcaccttcaccctggcccgtgacccacgcctggccaacatcaccgtcggctactccgacggctaccgccgggtcttcaccaacaagggccatgtgctgatcaacggccaccgcgtgccggtggtgggcaaggtctcgatgaatacgctgatggtggatgtcaccgatttccccgacgtgaagggtggcaacgaagtggtgctgttcggcaagcaggccggggctgaaataacccaggccgagatggaagaaatcaacgacgcgctgctcgccgacctgtacaccgtatggggcagcgccaacccgaagatgctcgtcgactga

SEQ ID NO: 50 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFCRTLLAASLALLITGQAPLYAAPPLSMDNGTDALTVQNSNAWVEVSASALQHNIRTLQAELGGKSRLCAVLKADAYGHGIGLVMPSIIAQGVPCVAVASNEEARVVRASGFTGQLVRVRLASLSELEDALQYDMEELVGSAEFARQVDAIAARHGKTLRIHMALNSSGMSRNGVEMTTWSGRGEALQITDQKHLKLVALMTHFAVEDKDDVRNGLAAFNEQTDWLIKHAKLDRSKLTLHAANSFATLEVPEARLDMVRTGGALFGDTVPARTEYQRAMQFKSHVAAVHSYPAGNTVGYDRTFTLARDPRLANITVGYSDGYRRVFTNKGHVLINGHRVPVVGKVSMNTLMVDVTDFPDVKGGNEVVLFGKQAGAEITQAEMEEINDALLADLYTVWGSANPKMLVD

SEQ ID NO: 51 - DNA, 1230 bp, Unknown
  Obtained from environmental sample
atgccatttcgccgtaccctcctcgccctgtccctcggtctcgtgctctggcaaggccaggtacatgcggcgccgccgatgtcgctggacaacggcacttcgcagctgaccgcgcaggtcagcaacgcctgggtggagatcaacaagactgccttcgagcacaacatccgcaccctgcaggcggagctcagtggcaagtcgaagctgtgcgcggtgctcaaggcggatgcctacggccacggcatcggcctgctgatgccgtcggtgatcgccatggacgtgccctgcgtcgccatcgccagcaacgaagaagcgcgggtggtgcgggccagcggcttcaagggcgaactggtgcgggtacgtaccggctccctggcggaagtcgaggatgccctcaagtacaacgtcgaggaactggtcggcaatgccgagttcgcccaccaggcgggcgagattgccgcgcgtcaaggccgcaagctgcgtgtgcacatcgcgttgaactccagcggcatgagtcgcaacgggctggaaatggaaagcgagcaaggccgccgcgacgccgtggccgttgcgaaggaaaagaaccccgaagtggtggcgatcatgacccactacgcggtggaggatcgcgaggatgtgctgaagggactggcggcgttcaaccggcaggccgactggctgatcaaggaagctggactggaccgcagcaagctgaccctgcacaccgccaactccttcgccaccctggaagtccccgaggcgcgcctggacatggtgcgtaccggcggtgcgctgttcggcgacaccgtggtcacccgcaccgagtacaagcgggtgatgcagttcaagtcgcacgtggcttcggtgaacgcctacccggcgggcaacagcgtcggctatgaccgcacctacaccatcaaccgcgactcgcggctggccaacatcaccgtcggctactccgatggctaccggcgggtattcaccaacaagggccatgtgctgatcgacggccaccgcgtgccggtggtgggcaaggtttcgatgaacaccctgatggttgacgtcaccgacttcccggacgtgaaggccggcgacgaagtggtgctgttcggcaagcagggcggcagcgagattgcccagagcgagatggaagacatcaatggtgcgctgctggccgacctgtacacggtctggggtagcgccaatccgaaagtgctggtcgagcaatag

SEQ ID NO: 52 - protein, 409 aa, Unknown
  Obtained from environmental sample
  SIGNAL (1)...(23)
  DOMAIN (42)...(271): Alanine racemase, N-terminal domain
  DOMAIN (279)...(407): Alanine racemase, C-terminal domain
  SITE (31)...(34): N-glycosylation site. Prosite id = PS00001
  SITE (48)...(51): N-glycosylation site. Prosite id = PS00001
  SITE (72)...(82): Alanine racemase pyridoxal-phosphate attachment site. Prosite id = PS00395
  SITE (169)...(172): N-glycosylation site. Prosite id = PS00001
  SITE (318)...(321): N-glycosylation site. Prosite id = PS00001
MPFRRTLLALSLGLVLWQGQVHAAPPMSLDNGTSQLTAQVSNAWVEINKTAFEHNIRTLQAELSGKSKLCAVLKADAYGHGIGLLMPSVIAMDVPCVAIASNEEARVVRASGFKGELVRVRTGSLAEVEDALKYNVEELVGNAEFAHQAGEIAARQGRKLRVHIALNSSGMSRNGLEMESEQGRRDAVAVAKEKNPEVVAIMTHYAVEDREDVLKGLAAFNRQADWLIKEAGLDRSKLTLHTANSFATLEVPEARLDMVRTGGALFGDTVVTRTEYKRVMQFKSHVASVNAYPAGNSVGYDRTYTINRDSRLANITVGYSDGYRRVFTNKGHVLIDGHRVPVVGKVSMNTLMVDVTDFPDVKAGDEVVLFGKQGGSEIAQSEMEDINGALLADLYTVWGSANPKVLVEQ

SEQ ID NO: 53 - DNA, 1230 bp, Unknown
  Obtained from environmental sample
atgcccttctgccgtacactcctcgccctgtccctcggtctcgtgctctggcaaggccaggcacatgcggcgccgccgatgtcactggacaacggcacttcgcagctgaccgcgcaggtcagcaacgcctgggtggagatcaacaagactgccttcgagcacaacatccgcaccctgcaggcggagctcggtggcaagtcgaagctgtgcgcggtgctcaaggcggatgcctacggccacggcatcggcctgctgatgccgtcggtgatcgccatggacgtgccctgcgtcgccatcgccagcaacgaagaagcgcgggtggtgcgggccagcggcttcaagggcgaactggtgcgggtacgtaccggctccctggcggaagtcgaggatgccctcaagtacaacgtcgaggaactggtcggcaatgccgagttcgcctaccaggcgggcgagattgccgcgcgtcaaggccgcaagctgcgtgtgcacatcgcgttgaactccagcggcatgagtcgcaacgggctggaaatggaaagcgagcaaggccgccgcgacgccgtggccattgcgaaggaaaagaacctcgaagtggtggcgatcatgacccactacgcggtggaggatcgcgaggatgtgctgaagggactggcggcgttcaaccggcaggccgactggctgatcaaggaagctggactggaccgcagcaagctgaccctgcacaccgccaactccttcgccaccctggaagtccccgaggcgcgcctggacatggtgcgtaccggcggtgcgctgttcggcgacaccgtggtcacccgcaccgagtacaagcgagtgatgcagttcaagtcgcacgtggcttcggtgaacgcctacccggcgggcaacagcgtcggctatgaccgcacctacaccatcaaccgcgactcgcggctggccaacatcaccgtcggctactccgatggctaccggcgggtattcaccaacaagggccatgtgctgatcgacggccaccgcgtgccggtggtgggcaaggtttcgatgaacaccctgatggtcgacgtcaccgacttcccggacgtgaaggccggcgacgaagtggtgctgttcggcaagcagggcggcagcgagattgcccagagcgagatggaagacatcaatggtgcgctgctggccgacctgtacacggtctggggcagcgccaatccgaaagtgctggtcgagcaatag

SEQ ID NO: 54 - protein, 409 aa, Unknown
  Obtained from environmental sample
  SIGNAL (1)...(23)
  DOMAIN (42)...(271): Alanine racemase, N-terminal domain
  DOMAIN (279)...(407): Alanine racemase, C-terminal domain
  SITE (31)...(34): N-glycosylation site. Prosite id = PS00001
  SITE (48)...(51): N-glycosylation site. Prosite id = PS00001
  SITE (72)...(82): Alanine racemase pyridoxal-phosphate attachment site. Prosite id = PS00395
  SITE (169)...(172): N-glycosylation site. Prosite id = PS00001
  SITE (318)...(321): N-glycosylation site. Prosite id = PS00001
MPFCRTLLALSLGLVLWQGQAHAAPPMSLDNGTSQLTAQVSNAWVEINKTAFEHNIRTLQAELGGKSKLCAVLKADAYGHGIGLLMPSVIAMDVPCVAIASNEEARVVRASGFKGELVRVRTGSLAEVEDALKYNVEELVGNAEFAYQAGEIAARQGRKLRVHIALNSSGMSRNGLEMESEQGRRDAVAIAKEKNLEVVAIMTHYAVEDREDVLKGLAAFNRQADWLIKEAGLDRSKLTLHTANSFATLEVPEARLDMVRTGGALFGDTVVTRTEYKRVMQFKSHVASVNAYPAGNSVGYDRTYTINRDSRLANITVGYSDGYRRVFTNKGHVLIDGHRVPVVGKVSMNTLMVDVTDFPDVKAGDEVVLFGKQGGSEIAQSEMEDINGALLADLYTVWGSANPKVLVEQ

SEQ ID NO: 55 - DNA, 1230 bp, Unknown
  Obtained from environmental sample
atgcccttttgccgtacactgctcgccctgtccctcggtctcgtgctctggcaaggccaggtacatgcggcgccgccgatgtcgctggacaacggcacttcgcagctgaccgcgcaggtcagcaacgcctgggtggagatcaacaagactgccttcgagcacaacatccgcaccctgcaggcggagctcggtggcaagtcgaagctgtgcgcggtgctcaaggcggatgcctacggccacggcatcggcctgctgatgccgtcggtgatcgccatggacgtgccctgcgtcgccatcgccagcaacgaagaagcgcgggtggtgcgggccagcggcttcaagggcgaactggtgcgggtacgtaccggcttcctggcggaagtcgaggatgccctcaagtacaacgtcgaggaactggtcggcaatgccgagttcgcccaccaggcgggcgagattgccgcgcgtcaaggccgcaagctgcgtgtgcacatcgcgttgaactccagcggcatgagtcgcaacgggctggaaatggaaagcgagcaaggtcgccgcgacgccgtggccgttgcgaaggaaaagaacctcgaagtggtggcgatcatgacccactacgcagtggaggatcgcgaggatgtgctgaagggactggcggcgttcaaccggcaggccgactggctgatcaaggaagctggactggaccgcagcaagctgaccctgcacaccgccaactccttcgccaccctggaagtccccgaggcgcgcctggacatggtgcgtactggcggtgcgctgttcggcgacaccgtggtcacccgcaccgagtacaagcgggtgatgcagttcaagtcgcacgtggcttcggtgaacgcctacccggcgggcaacagcgtcggctatgaccgcacctacaccatcaaccgcgactcgcggctggccaacatcaccgtcggctactccgatggctaccggcgggtattcaccaacaagggccatgtgctgatcgacggccaccgcgtgccggtggtgggcaaggtttcgatgaacaccctgatggtcgacgtcaccgacttcccggacgtgaaggccggcgacgaagtggtgctgttcggcaagcagggcggcagcgagattgcccagagcgagatggaagacatcaatggtgcgctgctggccgacctgtacacggtctggggcagcgccaatccgaaagtgctggtcgagcaatag

SEQ ID NO: 56 - protein, 409 aa, Unknown
  Obtained from environmental sample
  SIGNAL (1)...(23)
  DOMAIN (42)...(271): Alanine racemase, N-terminal domain
  DOMAIN (279)...(407): Alanine racemase, C-terminal domain
  SITE (31)...(34): N-glycosylation site. Prosite id = PS00001
  SITE (48)...(51): N-glycosylation site. Prosite id = PS00001
  SITE (72)...(82): Alanine racemase pyridoxal-phosphate attachment site. Prosite id = PS00395
  SITE (169)...(172): N-glycosylation site. Prosite id = PS00001
  SITE (318)...(321): N-glycosylation site. Prosite id = PS00001
MPFCRTLLALSLGLVLWQGQVHAAPPMSLDNGTSQLTAQVSNAWVEINKTAFEHNIRTLQAELGGKSKLCAVLKADAYGHGIGLLMPSVIAMDVPCVAIASNEEARVVRASGFKGELVRVRTGFLAEVEDALKYNVEELVGNAEFAHQAGEIAARQGRKLRVHIALNSSGMSRNGLEMESEQGRRDAVAVAKEKNLEVVAIMTHYAVEDREDVLKGLAAFNRQADWLIKEAGLDRSKLTLHTANSFATLEVPEARLDMVRTGGALFGDTVVTRTEYKRVMQFKSHVASVNAYPAGNSVGYDRTYTINRDSRLANITVGYSDGYRRVFTNKGHVLIDGHRVPVVGKVSMNTLMVDVTDFPDVKAGDEVVLFGKQGGSEIAQSEMEDINGALLADLYTVWGSANPKVLVEQ

SEQ ID NO: 57 - DNA, 1230 bp, Unknown
  Obtained from environmental sample
atgccattttcccgtacactactggctgcatccctcgctctgctgatcaccggccaggccccgttgtacgccgcaccacccctgtcgatggacaacggcaccgccgccctgaccgcgcaaaacagcaacgcctgggtcgaaatcagtgccggcgcgctgcaacacaacatccgtaccttgcaggccgagctgggcgacaagtccaagttgtgcgccgtgctcaaggccgacgcctatggccacggtatcggcctggtgatgccgtcgatcatcgcccagggcgtgccttgcgtggcggtggccagcaacgaggaggcccgcgtggttcgcgccagcggcttcaccgggcaactggtgcgggtacgcctggccagcctcagcgaagtggaagatgccttgcagtacgacatggaagaactggtcggcagcgccgagttcgcccgccagctcgatgccatcgccgaacgccacggcaagaccctgcgcattcacatggcgctcaattccagtggcatgagccgcaacggcgtggaaatgaccacctggtccggccggggtgaagcgctgcagatcaccgaccagaagcacctcgagctggtcgcgctgatgacccacttcgccgtggaagacaaggacgatgtgcgcaaaggcctggcagcgttcaacgagcagaccgactggctgatcaagcacgcgaaacttgatcgcagcaagctcaccctgcacgccgccaactccttcgctacgctggaagtgccggaagcgcgcctggacatggtgcgcaccggcggcgcgctgttcggcgacaccgtgccgacgcacaccgaataccaacgtgccatgcagttcaagtcgcacgtggcagcggtgcacagctacccggcaggcaacaccgtcggctatgaccgcaccttcaccctggcgcgtgattcgcgcctggcgaacatcaccgtcggctactccgatggctaccgccgggtgttcaccaacaagggccatgtgctgatcaacggccaccgtgtgccggtggtgggcaaggtgtcgatgaacacgttgatggtcgatgtcaccgacttccccgatgtgaagggtggcaacgaagtggtgctgttcggcaaacaggccgggggtgaaatcacccaggccgaaatggaagaaatcaacggcgcgctgctcgccgacctgtacaccgtatggggcagttccaacccgaagattctcgtcgactga

SEQ ID NO: 58 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFSRTLLAASLALLITGQAPLYAAPPLSMDNGTAALTAQNSNAWVEISAGALQHNIRTLQAELGDKSKLCAVLKADAYGHGIGLVMPSIIAQGVPCVAVASNEEARVVRASGFTGQLVRVRLASLSEVEDALQYDMEELVGSAEFARQLDAIAERHGKTLRIHMALNSSGMSRNGVEMTTWSGRGEALQITDQKHLELVALMTHFAVEDKDDVRKGLAAFNEQTDWLIKHAKLDRSKLTLHAANSFATLEVPEARLDMVRTGGALFGDTVPTHTEYQRAMQFKSHVAAVHSYPAGNTVGYDRTFTLARDSRLANITVGYSDGYRRVFTNKGHVLINGHRVPVVGKVSMNTLMVDVTDFPDVKGGNEVVLFGKQAGGEITQAEMEEINGALLADLYTVWGSSNPKILVD

SEQ ID NO: 59 - DNA, 1230 bp, Unknown
  Obtained from environmental sample
atgcccttctgccgtaccctactggctgcatccctggcgctgctgatcactggccaggccccgctgtacgccgcaccgccgctgtcgatggacaacggcaccacggccctgaccgtgcagaacagcaacgcctgggtcgaaatcagtgccggcgcgctgcaacacaacatccgtaccttgcaagccgagctgggcggcaagtccaagctgtgcgccgtgctcaaggccgacgcctatggccacggtgtcggcctggtgatgccgtcgatcatcgcccagggcgtgccctgcgtggcggtggccagcaacgaggaggcccgcgtggtccgcgccagcggcttcaccgggcaactggtgcgggtacgcctggccagcgtcagcgaagtggaagatgccctgcagtacgacatggaagagctggtcggcagcgccgagttcgcccgccaactcgatgccatcgccgaacgccacggcaagaccctgcgcatccatatggcgctcaattccagcggcatgagccgcaacggcgtggaaatggccacctggtccggccgtggcgaagcgctgcagatcaccgaccagaagcacctcaagctggtcgcgctgatgacccacttcgcggtggaagacaaggacgatgtgcgcaaaggcctggcagcgttcaacgagcagaccgactggctgatcaagcacgcgaagcttgatcgcagcaagctcaccctgcacgccgccaactccttcgccacgctggaagtgccggaagcgcgcctggacatggtgcgcaccggcggcgcgttgttcggcgacaccgtgccgacgcataccgaataccaacgtgtgatgcagttcaagtcgcgcgtggcggcggtgcacagctacccggcaggcaacaccgtcggctacgaccgcaccttcaccctggcgcgtgattcgcgcctggccaacgtcaccgtcggctactccgatggctaccgccgggcgttcaccaacaagggccatgtgctgatcaacggccaccgtgtgccggtggtgggcaaggtgtcgatgaacacgttgatggtcgatgtcaccgacttccccgatgtaaaaggtggcaacgaagtggtgctgtttggcaaacaggccgagggtgaaatcacccaggccgagatggaagaaatcaacggcgcgctgctcgccgacctgtacaccgtatggggcagctccaacccgaagattcttgtcgactga

SEQ ID NO: 60 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFCRTLLAASLALLITGQAPLYAAPPLSMDNGTTALTVQNSNAWVEISAGALQHNIRTLQAELGGKSKLCAVLKADAYGHGVGLVMPSIIAQGVPCVAVASNEEARVVRASGFTGQLVRVRLASVSEVEDALQYDMEELVGSAEFARQLDAIAERHGKTLRIHMALNSSGMSRNGVEMATWSGRGEALQITDQKHLKLVALMTHFAVEDKDDVRKGLAAFNEQTDWLIKHAKLDRSKLTLHAANSFATLEVPEARLDMVRTGGALFGDTVPTHTEYQRVMQFKSRVAAVHSYPAGNTVGYDRTFTLARDSRLANVTVGYSDGYRRAFTNKGHVLINGHRVPVVGKVSMNTLMVDVTDFPDVKGGNEVVLFGKQAEGEITQAEMEEINGALLADLYTVWGSSNPKILVD

SEQ ID NO: 61 - DNA, 1614 bp, Unknown
  Obtained from environmental sample
ttgtttactatgatttttatgaaaaaaaaattttgcctattgtttgcaacgattattctgtttattacgtgtctatgttttttgttaaaaagcgtctcagaaacaaatctgcataaaaaaataaatattgaaatgcattttgataacttagtgtctaattttgaaaaaattagaaaattaaacaacgaaaatgttgatgtagctgataaagtaataccggtcgtaaaggcaaatgcatataattttggagtttatgacatcactaagacttttttatcaatgaaagaaccacaaacaaagttttttgtttttagtctggaagaaggcattgagctcaggaaattttttccatccatagagagaatatttgtaataatgggggctctggaaaacgacgcggagttatttaaaaaatataacttaactcctgttgtaaattctttttatcagctggaagtgtgcaaaaagcataacattaaaaacattgtattacagtttaatacagggatgaatagaaatggatttgaagtaaaagaattaagaaaagttaaacaaatttgtgatagtgaaaaatttaatgtattaatggtaatgagccattttgcttgtagcgacaatatggccagtgaagtcaatgcatatcaaataaatgaatataaaaaagtggcacgagtttttaatgataaaaagattattaaatcttttcctgcaacttttggtatattaaattttaatactataaatggattagttaactcttttagacccggaagattatattatggatttcttccaaaagaaggatatgataaaaatttgttttctgtttatgtttatctaagtaaagataaagaaggaaatattattttgccgttcggtaaagaagatggtattgactatggtgagcaagcatatattttagtggataaaaataaggcatatgtaaagcaagtagatagtcataaagtaatattagatacaaacgataaaacattagttggcaaaaaagtatatctaataaaaaatggtatgggatatgatgagtttaaagaacaatctaaacaagacctgctaactttttttggaaaaatctttaaaaattgcgataaaaataaaaatttatgcaatatcaatgcaacaaggaagagagccaaaaaagacaataaatttgttccaaaagcaatatttaaaaaggatgcgaaaggacaatatactcaatatacaactactttatttgagaaacgagaagttagtgctgacggtattgttggatatgatgcaacaagagctgtaaaaaaaggtgacaagttaggtgtaatttttaatggtcatatggatggtttttatcagcctatgagtaataaacatgtgtttgtttatgtgaaaaacaaatacaaacaacttataccttgtgaattttatggtttgatttcttccgatcaggctgtaattaaaattcctaatgatgagtttgataatatagagtatggtgcaaaggttgtggtttttgacaaaaatcacccaataacattatttgagcaagcaacaggtgtttcaagagatgaattattttatggattagataagacatatagaatagcagaacaaaaataa

SEQ ID NO: 62 - protein, 537 aa, Unknown
  Obtained from environmental sample
  SIGNAL (1)...(33)
  DOMAIN (40)...(266): Alanine racemase, N-terminal domain
  SITE (383)...(386): N-glycosylation site. Prosite id = PS00001
MFTMIFMKKKFCLLFATIILFITCLCFLLKSVSETNLHKKINIEMHFDNLVSNFEKIRKLNNENVDVADKVIPVVKANAYNFGVYDITKTFLSMKEPQTKFFVFSLEEGIELRKFFPSIERIFVIMGALENDAELFKKYNLTPVVNSFYQLEVCKKHNIKNIVLQFNTGMNRNGFEVKELRKVKQICDSEKFNVLMVMSHFACSDNMASEVNAYQINEYKKVARVFNDKKIIKSFPATFGILNFNTINGLVNSFRPGRLYYGFLPKEGYDKNLFSVYVYLSKDKEGNIILPFGKEDGIDYGEQAYILVDKNKAYVKQVDSHKVILDTNDKTLVGKKVYLIKNGMGYDEFKEQSKQDLLTFFGKIFKNCDKNKNLCNINATRKRAKKDNKFVPKAIFKKDAKGQYTQYTTTLFEKREVSADGIVGYDATRAVKKGDKLGVIFNGHMDGFYQPMSNKHVFVYVKNKYKQLIPCEFYGLISSDQAVIKIPNDEFDNIEYGAKVVVFDKNHPITLFEQATGVSRDELFYGLDKTYRIAEQK

SEQ ID NO: 63 - DNA, 1230 bp, Unknown
  Obtained from environmental sample
atgccatttcgccgtacccttctggccgcatccctggccctgctgatcacaggtcttgccccactgtatgccgcacctccgctgtcgatggacaacggcaccaacgccctgaccgtgcagaacagcaacgcctgggtcgaagtcagcgccagcgcactgcaacacaacatccgcaccttgcaggccgagctggccggcaagtccaagctgtgcgccgtgctcaaggctgatgcctatggccacggtatcggcttggtaatgccatcgatcatcgcccagggcgtgccctgcgtggcggtggccagcaacgaggaggcccgcgtggtccgcgccagtggcttcaccgggcaactggtgcgggtacgcctggccagcctcaacgagccggaagatgccttgcagtacgacatggaagagctggtcggcagcgccgagttcgcccgccaggtcgatgctatcgccgcacgccacggcaagaccttgcgcattcatatggcgctcaactccagtggcatgagccgcaatggggtagaaatggccacctggtccggccgtggcgaagcgctgcagatcaccgatcagcagcacctcaagctggtcgcgctgatgacccacttcgccgtggaagacaaggacgacgtacgcaaaggcctggcggccttcaacgagcagaccgactggctgatcaagcacgccaagctcgaccgcagcaagctcaccctgcacgccgccaactcgttcgccacgctggaggtgccagaagcccgcctggacatggtgcgcaccggtggtgcgctgttcggtgacaccgtgccggcgcgcaccgaatacaaacgcgccatgcagttcaagtcgcacgtggcggcggtgcacagctacccggccggcaacaccgtcggttacgaccgtaccttcaccctggcccgtgattcgcgcctggccaacatcaccgtcggctattccgatggctatcgccgggtgttcaccaacaagggccatgtgctgatcaacggccaccgcataccggtggtgggcaaggtgtcgatgaacacgctgatggtcgatgtcaccgacttcccggacgtgaagggcggcaacgaagtggtgctgttcggcaagcaggccgggggcgaaatcacccaggccgagatggaagaaatcaacggcgcgctgctggccgacctgtacaccgtgtggggcagctccaacccgaagatcctcgtcgactga

SEQ ID NO: 64 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFRRTLLAASLALLITGLAPLYAAPPLSMDNGTNALTVQNSNAWVEVSASALQHNIRTLQAELAGKSKLCAVLKADAYGHGIGLVMPSIIAQGVPCVAVASNEEARVVRASGFTGQLVRVRLASLNEPEDALQYDMEELVGSAEFARQVDAIAARHGKTLRIHMALNSSGMSRNGVEMATWSGRGEALQITDQQHLKLVALMTHFAVEDKDDVRKGLAAFNEQTDWLIKHAKLDRSKLTLHAANSFATLEVPEARLDMVRTGGALFGDTVPARTEYKRAMQFKSHVAAVHSYPAGNTVGYDRTFTLARDSRLANITVGYSDGYRRVFTNKGHVLINGHRIPVVGKVSMNTLMVDVTDFPDVKGGNEVVLFGKQAGGEITQAEMEEINGALLADLYTVWGSSNPKILVD

SEQ ID NO: 65 - DNA, 1230 bp, Unknown
  Obtained from environmental sample
atgccctttccccgtacacttctggccgcatccctggccctgctgatcaccggtcaagcccccctgtatgccgcacctccgctgtcgatggacaatggcaccaacgccctgaccgtgcagaacagcaacgcctgggtcgaagtcagcgccagcgccctgcaacacaacatccgcaccctgcaggccgagctggctggcaagtccaggctgtgcgccgtgctcaaggccgacgcctatggccacggtatcggcctggtgatgccgtctatcattgcccagggcgtgccctgcgtggcggtggccagcaacgaggaggcccgcgtggtccgcgccagtggcttcaccgggcaactggtgcgggtacgcctggccagcctcagcgagctggaagatgccttgcagtacgacatggaagagctggtcggcagcgccgaatttgcccgccaggtcgattccatcgccgcacgccacggcaagaccctgcgcatacatatggcgctcaactccagtggcatgagccgcaacggtgtagagatggcgacctggtccggccgtggcgaagcgctgcagatcaccgatcagaagcacctcgagctggttgcgctgatgacccacttcgccgtcgaagacaaggacgatgtccgcaagggcctggcggccctcaacgagcagaccgattggttgatcaagcacgcgaagctcgaccgcagcaaactcaccctgcacgccgccaactcgttcgctaccctggaggtgccggaggcgcgcctggacatggtacgcaccggcggcgcgctgttcggtgacaccgtgccggcgcgcaccgagtacaaacgcgccatgcagttcaagtcgcacgtggcggcggtgcacagctacccggccggcaacaccgtcggctacgaccgtaccttcaccctggcccgtgattcgcgcctggccaacatcaccgtcggctattccgatggctatcgccgggtgttcaccaacaagggccatgtgctgatcaacggccaccgcataccggtggtgggcaaggtgtcgatgaacacgctgatggtcggtgtcaccgacttcccggacgtgaagggggacaacgaagtggtgctgttcggcaagcaggccgggggcgaaatcacccaggccgagatggaagaaatcaacggcgcgctgctggccgacctgtacaccgtgtggggcagctccaacccgaagatcctcgtcgactga

SEQ ID NO: 66 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFPRTLLAASLALLITGQAPLYAAPPLSMDNGTNALTVQNSNAWVEVSASALQHNIRTLQAELAGKSRLCAVLKADAYGHGIGLVMPSIIAQGVPCVAVASNEEARVVRASGFTGQLVRVRLASLSELEDALQYDMEELVGSAEFARQVDSIAARHGKTLRIHMALNSSGMSRNGVEMATWSGRGEALQITDQKHLELVALMTHFAVEDKDDVRKGLAALNEQTDWLIKHAKLDRSKLTLHAANSFATLEVPEARLDMVRTGGALFGDTVPARTEYKRAMQFKSHVAAVHSYPAGNTVGYDRTFTLARDSRLANITVGYSDGYRRVFTNKGHVLINGHRIPVVGKVSMNTLMVGVTDFPDVKGDNEVVLFGKQAGGEITQAEMEEINGALLADLYTVWGSSNPKILVD

SEQ ID NO: 67 - DNA, 1230 bp, Unknown
  Obtained from environmental sample
atgccattccgccgtacactcctggcagcttccctggccctgctggtgactgcccaggccccgctgtatgcggcgccgccgttgtcgctggacaacggcgtcaacgccatgaccatccagaacagcaacgcctgggtcgagatcagcaagagcgccatcgaacacaacatccgtaccctgcagacggaactcaacggcaagtccaagctgtgcgcggtactcaaggctgacgcctacggccacggcatcggcctggtgatgccctcgatcatcgccatggacgtgccctgcgtggcggtggccagcaacgaggaagcccgcgtcgttcgtgccagcggtttccaaggccaactggtgcgggtgcgcctggccagcgtgagcgaggtggaagacgccttgcagtacaacatggacgagttagtcggcagcgccgaattcgcccggcaggtggcggcgatcgcccagcgccacggcaagaccctgcgcatccacctggccctgaactccagcggcatgagccgcaacggcgtggaaatggccagttggtcgggccgcggcgaagcactggaaatcgccgaacagccgaacctggagctggtggcgctgatgacccacttcgccgtcgaagacaaagatgacgtgcgcaagggcctggcggccttcaaggagcagagcgactggctgatcaagcacgccaagctcgaccgcagcaagctgaccctgcacgcggccaactccttcgccaccctggaggtgccggaggcccgcctggacatggtgcgcaccggcggtgcgctgttcggcgacactgtgccgacccgcaccgagtaccgccgcgccatgcagttcaagtcccgcgttgcggccgtgcacagctacccggccggcaataccgtcggctatgaccgcaccttcaccctggcccgtgactcgcgcctggccaacatcaccgtcgggtattccgacggctatcgccgggtgttcaccaacaaaggccatgtgctgatcaacggccatcgcgtgccggtggtgggcaaggtgtcgatgaacaccttgatggtggatgtcaccgacttccctgacgtcaagaacggcaacgaggcggtgctgttcggcaagcaggccggcggtgagatcacccagagcgaaatggaagaaatcaacgatgcgctgctggccgacctgtacacggtctggggcagtgccaacccgaagatcctcgtcgactga

SEQ ID NO: 68 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFRRTLLAASLALLVTAQAPLYAAPPLSLDNGVNAMTIQNSNAWVEISKSAIEHNIRTLQTELNGKSKLCAVLKADAYGHGIGLVMPSIIAMDVPCVAVASNEEARVVRASGFQGQLVRVRLASVSEVEDALQYNMDELVGSAEFARQVAAIAQRHGKTLRIHLALNSSGMSRNGVEMASWSGRGEALEIAEQPNLELVALMTHFAVEDKDDVRKGLAAFKEQSDWLIKHAKLDRSKLTLHAANSFATLEVPEARLDMVRTGGALFGDTVPTRTEYRRAMQFKSRVAAVHSYPAGNTVGYDRTFTLARDSRLANITVGYSDGYRRVFTNKGHVLINGHRVPVVGKVSMNTLMVDVTDFPDVKNGNEAVLFGKQAGGEITQSEMEEINDALLADLYTVWGSANPKILVD

SEQ ID NO: 69 - DNA, 1230 bp, Unknown
  Obtained from environmental sample
atgccattttgccgtaccctgctggctgcatccctggccctgctgatcactggccaggccccactgtacgctgcaccaccgctgtcaatggacaacggcaccaacgccctgaccgtgcagaacagcaacgcctgggtcgaagtcagtgccagcgccctgcaacacaacatccgcaccttgcaggccgagccgggcggcaagtccaggctgtgcgccgtgctcaaggccgacgcctacggccatggcatcggcctggtaatgccgtcgataatcgcccaaggcgtgccctgcgtggcggtggccagtaacgaagaggcccgcgtggtccgcgccagcggctttaccgggcaactggtgcgggtacgcctggccagcctcagcgagctggaagacgccttgcagtacgacatggaggagctggtcggcagcgccgagttcgcccgccaggtcgatgccgttgctgcccgccatggcaagaccctgcgcattcacatggcgctcaactcaagcggaatgagccgcaacggggtggagatgaccacctggtccggccgtggcgaagcgctgcagatcaccgatcagaaacacctcaaactggtcgcgctgatgacccactttgccgtggaggacaaggacgatgtacgcaaaggcctggcggggttcaacgaacagaccgactggctgatcaagcacgccgggctcgaccgcagcaagcttaccctgcacgcggccaactcgttcgccacgctagaggtgccggaagcgcgcctggacatggtacgcacggggggcgcgctgttcggtgacaccgtgccggagcgcaccgaatacaaacgtgccatgcagttcaagtcgcacgtggcagcggtacacagttacccggccggcaacaccgttggctacgaccgcaccttcaccctggcacgtgactcgcggctggccaacatcaccgtcggttactccgacggctaccgccgggtcttcaccaacaagggccatgtgctgatcaacgggcaccgcgtgccggtggtgggcaaggtctcgatgaatacgctgatggtggatgtcaccgatttccccgacgtgaaagatggcaacgaagtggtgctgttcggcaagcaggccggggctgaaataacccagaccgagatggaagaaatcaacgacgcgctgctcgccgacctgtacaccgtatggggcagcgccaacccgaagatgctcgtcgactga

SEQ ID NO: 70 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFCRTLLAASLALLITGQAPLYAAPPLSMDNGTNALTVQNSNAWVEVSASALQHNIRTLQAEPGGKSRLCAVLKADAYGHGIGLVMPSIIAQGVPCVAVASNEEARVVRASGFTGQLVRVRLASLSELEDALQYDMEELVGSAEFARQVDAVAARHGKTLRIHMALNSSGMSRNGVEMTTWSGRGEALQITDQKHLKLVALMTHFAVEDKDDVRKGLAGFNEQTDWLIKHAGLDRSKLTLHAANSFATLEVPEARLDMVRTGGALFGDTVPERTEYKRAMQFKSHVAAVHSYPAGNTVGYDRTFTLARDSRLANITVGYSDGYRRVFTNKGHVLINGHRVPVVGKVSMNTLMVDVTDFPDVKDGNEVVLFGKQAGAEITQTEMEEINDALLADLYTVWGSANPKMLVD

SEQ ID NO: 71 - DNA, 1230 bp, Unknown
  Obtained from environmental sample
atgccatttcgccgtaccctgctggctgcatccctggccctgctgatcactggccaggccccactgtacgctgcaccaccgctgtcaatggacaacggcaccaacgccctgaccgtgcagaacagcaacgcctgggtcgaagtcagtgccagcgccctgcaacacaacatccgcaccttgcaggccgagctgggcggcaagtccaggctgtgcgctgtgctcaaggccgacgcctacggccatggcatcggcctggtaatgccgtcgataatcgcccaaggcgtgccctgcgtggcggtggccagtaacgaagaggcccgcgtggtccgcgccagcggctttaccgggcaactggtgcgggtacgcctggccagcctcagcgagctggaagacgccttgcagtacgacatggaggagctggtcggcagcgccgagttcgcccgccaggtcgatgccgttgctgcccgccatggcaagaccctgcgcattcacatggcgctcaactcaagcggaatgagccgcaacggggtggagatgaccacctggtccggccgtggcgaagcgctgcagatcaccgatcagaaacacctcaaactggtcgcgctgatgacccactttgccgtggaggacaaggacgatgtacgcaaaggcctggcggggttcaacgaacagaccgactggctgatcaagcacgccgggctcgaccgcagcaagcttaccctgcacgcggccaactcgttcgccacgctagaggtgccggaagcgcgcctggacatggtacgcacggggggcgcgctgttcggtgacaccgtgccggagcgcaccgaatacaaacgtgccatgcagttcaagtcgcacgtggcagcggtacacagttacccggccggcaacaccgttggctacgaccgcaccttccccctggcacgtgactcgcggctggccaacatcaccgtcggttactccgacggctaccgccgggtcttcaccaacaagggccatgtgctgatcaacgggcaccgcgtgccggtggtgggcaaggtctcgatgaatacgctgatggtggatgtcaccgatttccccgacgtgaaaggtggcaacgaagtggtgctgttcggcaagcaggccggggctgaaataacccagaccgagatggaagaaatcaacgacgcgctgctcgccgacctgtacaccgtatggggcagcgccaacccgaagatgctcgtcgactga

SEQ ID NO: 72 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFRRTLLAASLALLITGQAPLYAAPPLSMDNGTNALTVQNSNAWVEVSASALQHNIRTLQAELGGKSRLCAVLKADAYGHGIGLVMPSIIAQGVPCVAVASNEEARVVRASGFTGQLVRVRLASLSELEDALQYDMEELVGSAEFARQVDAVAARHGKTLRIHMALNSSGMSRNGVEMTTWSGRGEALQITDQKHLKLVALMTHFAVEDKDDVRKGLAGFNEQTDWLIKHAGLDRSKLTLHAANSFATLEVPEARLDMVRTGGALFGDTVPERTEYKRAMQFKSHVAAVHSYPAGNTVGYDRTFPLARDSRLANITVGYSDGYRRVFTNKGHVLINGHRVPVVGKVSMNTLMVDVTDFPDVKGGNEVVLFGKQAGAEITQTEMEEINDALLADLYTVWGSANPKMLVD

SEQ ID NO: 73 - DNA, 1230 bp, Unknown
  Obtained from environmental sample
atgcccttttgccgtacactcctggctgcatccctggccctgctgatcactggccaggccccactgtacgctgcaccaccgctgtcaatggacaacggcaccaacgccctgaccgtgcagaacagcaacgcctgggtcgaagtcagtgccagcgccctgcaacacaacatccgcaccttgcaggccgagctgggcggcaagtccaggctgtgcgccgtgctcaaggccgacgcctacggccatggcatcggcctggtaatgccgtcgataatcgcccaaggcgtgccctgcgtggcggtggccagtaacgaagaggcccgcgtggtccgcgccagcggctttaccgggcaactggtgcgggtacgcctggccagcctcagcgagctggaagacgccttgcagtacgacatggaggagctggtcggcagcgccgagttcgcccgccaggtcgatgccgttgctgcccgccatggcaagaccctgcgcattcacatggcgctcaactcaagcgggatgagccgcaacggggtggagatgaccacctggtccggccgtggcgaagcgctgcagatcaccgatcagaaacacctcaaactggtcgcgctgatgacccactttgccgtggaggacaaggacgatgtacgcaaaggcctggcggggttcaacgaacagaccgactggctgatcaagcacgccgggctcgaccgcagcaagcttgccctgcacgcggccaactcgttcgccacgctagaggtgccggaagcgcgcctggacatggtacgcacggggggcgcgctgttcggtgacaccgtgccggagcgcaccgaatacaaacgtgccatgcagttcaagtcgcacgtggcagcggtacacagttacccggccggcaacaccgttggctacgaccgcaccttcaccctggcacgtgactcgcggctggccaacatcaccgtcggttactccgacggctaccgccgggtcttcaccaacaagggccatgtgctgatcaacgggcaccgcgtgccggtggtgggcaaggtctcgatgaatacgctgatggtggatgtcaccgatttccccgacgtgaaagatggcaacgaagtggtgctgttcggcaagcaggccggggctgaaataacccagaccgagatggaagaaatcaacgacgcgctgctcgccgacctgtacaccgtatggggcagcgccaacccgaagatgctcgtcgactga

SEQ ID NO: 74 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFCRTLLAASLALLITGQAPLYAAPPLSMDNGTNALTVQNSNAWVEVSASALQHNIRTLQAELGGKSRLCAVLKADAYGHGIGLVMPSIIAQGVPCVAVASNEEARVVRASGFTGQLVRVRLASLSELEDALQYDMEELVGSAEFARQVDAVAARHGKTLRIHMALNSSGMSRNGVEMTTWSGRGEALQITDQKHLKLVALMTHFAVEDKDDVRKGLAGFNEQTDWLIKHAGLDRSKLALHAANSFATLEVPEARLDMVRTGGALFGDTVPERTEYKRAMQFKSHVAAVHSYPAGNTVGYDRTFTLARDSRLANITVGYSDGYRRVFTNKGHVLINGHRVPVVGKVSMNTLMVDVTDFPDVKDGNEVVLFGKQAGAEITQTEMEEINDALLADLYTVWGSANPKMLVD

SEQ ID NO: 75 - DNA, 1230 bp, Unknown
  Obtained from environmental sample
atgccctttccccgtacactgctggctgcatccctggccctgctgatcactggccaggccccactgtacgctgcaccaccgctgtcaatggacaacggcaccaacgccctgaccgtgcagaacagcaacgcctgggtcgaagtcagtgccagcgccctgcaacacaacatccgcaccttgcaggccgagctgggcggcaagtccaggctgtgcgccgtgctcaaggccgacgcctacggccatggcatcggcctggtaatgccgtcgataatcgcccaaggcgtgccctgcgtggcggtggccagtaacgaagaggcccgcgtggtccgcgccagcggctttaccgggcaactggtgcgggtacgcctggccagcctcagcgagctggaagacgccttgcagtacgacatggaggagctggtcggcagcgccgagttcgcccgccaggtcgatgccgttgctgcccgccatggcaagaccctgcgcattcacatggcgctcaactcaagcggaatgagccgcaacggggtggagatgaccacctggtccagccgtggcgaagcgctgcagatcaccgatcagaaacacctcaaactggtcgcgctgatgacccactttgccgtggaggacaaggacgatgtacgcaaaggcctggcggggttcaacgaacagaccgactggctgatcaagcacgccgggctcgaccgcagcaagcttaccctgcacgcggccaactcgttcgccacgctagaggtgccggaagcgcgcctggacatggtacgcacggggggcgcgctgttcggtgacaccgtgccggagcgcaccgaatacaaacgtgccatgcagttcaagtcgcacgtggcagcggtacacagttacccggccggcaacaccgttggctacgaccgcaccttcaccctggcacgtgactcgcggctggccaacatcaccgtcggttactccgacggctaccgccgggtcttcaccaacaagggccatgtgctgatcaacgggcaccgcgtgccggtggtgggcaaggtctcgatgaatacgctgatggtggatgtcaccgatttccccgacgtgaaagatggcaacgaagtggtgctgttcggcaagcaggccggggctgaaataacccagaccgagatggaagaaatcaacgacgcgctgctcgccgacctgtacaccgtatggggcagcgccaacccgaagatgctcgtcgactga

SEQ ID NO: 76 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFPRTLLAASLALLITGQAPLYAAPPLSMDNGTNALTVQNSNAWVEVSASALQHNIRTLQAELGGKSRLCAVLKADAYGHGIGLVMPSIIAQGVPCVAVASNEEARVVRASGFTGQLVRVRLASLSELEDALQYDMEELVGSAEFARQVDAVAARHGKTLRIHMALNSSGMSRNGVEMTTWSSRGEALQITDQKHLKLVALMTHFAVEDKDDVRKGLAGFNEQTDWLIKHAGLDRSKLTLHAANSFATLEVPEARLDMVRTGGALFGDTVPERTEYKRAMQFKSHVAAVHSYPAGNTVGYDRTFTLARDSRLANITVGYSDGYRRVFTNKGHVLINGHRVPVVGKVSMNTLMVDVTDFPDVKDGNEVVLFGKQAGAEITQTEMEEINDALLADLYTVWGSANPKMLVD

SEQ ID NO: 77 - DNA, 1230 bp, Unknown
  Obtained from environmental sample
atgccctttcgccgtaccctactggccgcttccctggccctgctgatcactggccaggctccgctgtacgctgcgccgccgctgtcgatggacaacggcaccaccgctttgaccgtgcaaaacagcaacgcctgggtcgaaatcagcgccagcgccctgcaacacaacatccgcaccttgcaggccgaactggccggcaagtccaagctgtgtgccgtgctcaaggccgatgcctatggccacggtgtcggcctggtgatgccgtcgatcattgcccagggcgtgccctgcgtggcggtggccagcaacgaggaagcccgcgtggtccgcgccagtggctttaccgggcaactggtacgggtgcgcctggccagcctcagcgaagtggaagacgccttgcagtacgacatggaagagctggttggcagcgccgaattcgcccgccagctcgatgccatcgccgagcgccatggcaagcccctgcgcatccacttggcgctcaattccagcggcatgagccgcaacggggtggagatgagcacctggtccggccgtggcgaagcgctgcagatcactgaccagaaacacctcaagctggttgcgctgatgacccactttgccgtggaagacaaggacgatgtgcgtaagggtttggcagcgttcaacgagcagaccgactggctgatcaagcacgccaagctcgaccgcagcaagctcaccctgcacgccgccaactcgttcgctacgctggaggtgccggaagcgcgcctggacatggtgcgcaccggtggcgcgctgttcggtgacaccgtaccgagccacaccgagtaccagcgtgccatgcagttcaagtcgcgtgtggccgccgtgcacagctacccggctggcaacaccgtcggctacgaccgcacctacaccctggcccgggattcgcggctggccaacatcaccgtcggttactccgacggttaccgccgggcgttcaccaacaagggccatgtgctgatcaacggccgccgtgtgccggtagtgggcaaggtgtcgatgaacacgttgatggtcgatgtcaccgacttcccggatgtgaaagggggcaacgaagtggtgctgttcggcaagcaggccgggggcgagatcactcagaccgaaatggaagacatcaacggcgcgttgctcgccgacctgtacaccgtgtggggtagttccaacccgaagatcctcgtcgactga

SEQ ID NO: 78 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFRRTLLAASLALLITGQAPLYAAPPLSMDNGTTALTVQNSNAWVEISASALQHNIRTLQAELAGKSKLCAVLKADAYGHGVGLVMPSIIAQGVPCVAVASNEEARVVRASGFTGQLVRVRLASLSEVEDALQYDMEELVGSAEFARQLDAIAERHGKPLRIHLALNSSGMSRNGVEMSTWSGRGEALQITDQKHLKLVALMTHFAVEDKDDVRKGLAAFNEQTDWLIKHAKLDRSKLTLHAANSFATLEVPEARLDMVRTGGALFGDTVPSHTEYQRAMQFKSRVAAVHSYPAGNTVGYDRTYTLARDSRLANITVGYSDGYRRAFTNKGHVLINGRRVPVVGKVSMNTLMVDVTDFPDVKGGNEVVLFGKQAGGEITQTEMEDINGALLADLYTVWGSSNPKILVD

SEQ ID NO: 79 - DNA, 1230 bp, Unknown
  Obtained from environmental sample
atgccattttgccgtacactactggctgcatccctcgctctgctgatcaccggccaggccccgctgtacgccgcaccacccctgtcgatggacaacggcaccgccgccctgaccgcgcaaaacagcaacgcctgggtcgaaatcagtgccggcgcgctgcaacacaacatccgtaccttgcaggccgagctgggcggcaagtccaagctgtgcgccgtgctcaaggccgacgcctatggccacggtatcggcctggtgatgccgtcgatcatcgcccagggcgtgccttgcgtggcggtggccagcaacgaggaggcccgcgtggtccgcgccagcggcttcaccgggcaactggtgcgggtacgcctggccagcctcagcgaagtggaagatgccttgcagtacaacatggaagaactggtcggcagcgccgagttcgcccgccagctcgatgccctcgccgaacgccacggcaagaccctgcgcattcatctggcgctcaattccagtggcatgagccgcaacggcgtggaaatgaccacctggtccggccggggtgaagcgctgcagatcaccgaccagaagcaccttgagctggtcgcgctgatgacccacttcgccgtggaagacaaggacgatgtgcgcaaagggctggcagcgttcaacgagcagaccgactggctgatcaaacacgcgaaactcgatcgcagcaagctcaccctgcacgccgccaactccttcgctacgctggaagtgccggaagcgcgcctggacatggtgcgcaccggcggcgcgctgttcggcgacaccgtgccgacgcacaccgaataccaacgtgccatgcagttcaagtcgcacgtggcagcggtgcacagctacccggcaggcaacaccgtcggctacgaccgcaccttcaccctggcgcgtgattcgcgcctggccaacatcaccgtcggctactccgatggctaccgccgggtgttcaccaacaagggccatgtgctgatcaacggccaccgtgtgccggtggtgggcaaggtgtcgatgaacacgttgatggtcgatgtcaccgacttccccgatgtgaagggtggcaacgaagtggtgctgttcggcaaacaggccgggggtgaaatcactcaggccgaaatggaagaaatcaacggcgcgctgctcgccggcctgtacaccgtatggggcagttccaacccgaagattctcgtcgactga

SEQ ID NO: 80 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFCRTLLAASLALLITGQAPLYAAPPLSMDNGTAALTAQNSNAWVEISAGALQHNIRTLQAELGGKSKLCAVLKADAYGHGIGLVMPSIIAQGVPCVAVASNEEARVVRASGFTGQLVRVRLASLSEVEDALQYNMEELVGSAEFARQLDALAERHGKTLRIHLALNSSGMSRNGVEMTTWSGRGEALQITDQKHLELVALMTHFAVEDKDDVRKGLAAFNEQTDWLIKHAKLDRSKLTLHAANSFATLEVPEARLDMVRTGGALFGDTVPTHTEYQRAMQFKSHVAAVHSYPAGNTVGYDRTFTLARDSRLANITVGYSDGYRRVFTNKGHVLINGHRVPVVGKVSMNTLMVDVTDFPDVKGGNEVVLFGKQAGGEITQAEMEEINGALLAGLYTVWGSSNPKILVD

SEQ ID NO: 81 - DNA, 1230 bp, Unknown
  Obtained from environmental sample
atgcccttctgccgtacactcctggctgcatccctggctctgctgatcactggccaggccccgctgtacgccgcaccgccactgtcgatggacaacggcaccacggccttgaccgtgcagaacagcaacgcctgggtcgaaatcagtgccagcgcgctgcaacacaacatccgtaccttgcaggccgaactgggcggcaagtccaagctgtgcgccgtgctcaaggccgacgcctatggccacggtatcggcctggtgatgccgtcgatcattgcccagggcgtgccctgcgtggcggtggccagcaacgaggaggcccgcgtggtccgcgccagcggcttcaccgggcaactggtgcgggtgcgcctggccagcctcagcgaagtggaagatgccctgcagtacgacatggaagagctggtcggcagcgccgagttcgcccgccaggtcgatgccatcgccgagcgccacggcaagaccctgcgcatccatatggcgctcaattccagcggcatgagccgcaacggggtggagatgaccacctggtccggccgtggcgaagcgctgcagatcaccgaccagaagcacctcaagctggtcgcgctgatgacccacttcgccgtggaggacaaggacgatgtgcgcaagggcctggcagcgttcaacgagcagaccgactggctgatcaagcacgcgaaacttgatcgcagcaagctcaccctgcacgccgccaactccttcgctacgctggaagtgccggaagcgcgcctggacatggtgcgcaccggcggcgcgctgtttggcgacacggtgccgacgcacaccgaataccagcgcgccatgcagttcaagtcgcacgtggcggcggtgcacagctacccggccggcaacaccgtcggctacgaccgcaccttcaccctggcgcgtgattcgcgcctggccaacatcaccgtcggttactccgatggctaccgccgggcgttcaccaacaagggccatgtgctgatcaacggccaccgggtaccggtggtgggcaaggtgtcgatgaacaccttgatggtcgatgtcaccgacttccccgacgtgaagggtggcaacgaagtggtgctgttcggcaaacaggccggggctgaaatcacccaggccgagatggaagaaatcaacggcgcgctgctcgccgacctgtacaccgtatggggcagttccaacccgaagattctcgtcgactga

SEQ ID NO: 82 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFCRTLLAASLALLITGQAPLYAAPPLSMDNGTTALTVQNSNAWVEISASALQHNIRTLQAELGGKSKLCAVLKADAYGHGIGLVMPSIIAQGVPCVAVASNEEARVVRASGFTGQLVRVRLASLSEVEDALQYDMEELVGSAEFARQVDAIAERHGKTLRIHMALNSSGMSRNGVEMTTWSGRGEALQITDQKHLKLVALMTHFAVEDKDDVRKGLAAFNEQTDWLIKHAKLDRSKLTLHAANSFATLEVPEARLDMVRTGGALFGDTVPTHTEYQRAMQFKSHVAAVHSYPAGNTVGYDRTFTLARDSRLANITVGYSDGYRRAFTNKGHVLINGHRVPVVGKVSMNTLMVDVTDFPDVKGGNEVVLFGKQAGAEITQAEMEEINGALLADLYTVWGSSNPKILVD

SEQ ID NO: 83 - DNA, 1230 bp, Unknown
  Obtained from environmental sample
atgccattctgccgtacactactggctgcatccctcgctctgctgatcaccggccaggccccgttgtacgccgcaccgcccctgtcgatggacaacggcaccacggccctgaccgtgcagaacagcaacgcctgggtcgaaatcagcgccggcgcgttgcaacacaacatccgtaccctgcaggcggagctgggcggcaagtccaagctgtgcgccgtgctcaaggccgacgcctatggccacggtgtcggcctggtgatgccgtcgatcatcgcccagggcgtgccctgcgtggcggtggccagcaacgaagaggcccgcgtggtccgcgccagcggcttcaccgggcaactggtgcgggtacgcctggccagcgtcagcgaagtggaagacgccctgcagtacgacatggaagagctggtcggcagcgccgagttcgcccgccagctcgatgccctcgccgaacgccacggcaagaccctgcgcattcatttggcgctgaactccagtggcatgagccgcaacggcgtggaaatgagcacctggtccggccggggtgaggcgctgcaggtcaccgaccagaagcacctcaagctggtcgcgctgatgacccacttcgccgtggaagacaaggacgatgtacgcaaaggcctggcagcgttcaacgagcagaccgactggctgattaagcacgcgaaacttgatcgcagcaagctcaccctgcacgccgccaactccttcgctacgctggaagtgccggaagcgcgcctggacatggtgcgtaccggtggcgcgctgttcggcgacaccgtgccgacgcataccgaataccaacgtgtgatgcagttcaagtcgcgcgtggcggcggtgcacagctacccggcaggcaacaccgtcggctatgaccgcaccttcaccctggcgcgtgactcgcgcctggccaacgtcaccgtcggctactccgatggctaccgccgggcgttcaccaacaagggccatgtgctgatcaatggccaccgtgtgccggtggtgggcaaggtgtcgatgaacaccttgatggtcgatgtcaccgacttccccgatgtgaagggtggcaacgaagtggtgctgttcggcaaacaggccgggggtgaaatcacccaggccgaaatggaagaaatcaacggcgcgctgctcgccgacctgtacaccgtatggggcagttccaacccgaagattctcgtcgactga

SEQ ID NO: 84 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFCRTLLAASLALLITGQAPLYAAPPLSMDNGTTALTVQNSNAWVEISAGALQHNIRTLQAELGGKSKLCAVLKADAYGHGVGLVMPSIIAQGVPCVAVASNEEARVVRASGFTGQLVRVRLASVSEVEDALQYDMEELVGSAEFARQLDALAERHGKTLRIHLALNSSGMSRNGVEMSTWSGRGEALQVTDQKHLKLVALMTHFAVEDKDDVRKGLAAFNEQTDWLIKHAKLDRSKLTLHAANSFATLEVPEARLDMVRTGGALFGDTVPTHTEYQRVMQFKSRVAAVHSYPAGNTVGYDRTFTLARDSRLANVTVGYSDGYRRAFTNKGHVLINGHRVPVVGKVSMNTLMVDVTDFPDVKGGNEVVLFGKQAGGEITQAEMEEINGALLADLYTVWGSSNPKILVD

SEQ ID NO: 85 - DNA, 1230 bp, Unknown
  Obtained from environmental sample
atgccattttcccgtacccttctggctgcatccctggcgctgctgatcactggccaagccccgctgttcgctgcaccaccgctgtcgatggacaacggcaccaacgccctgaccgtgcagaacagcaacgcctgggtcgaagtcagtgccagcgccctgcaacgcaacattcgcactttgcaggccgagctgggcggcaagtccaggctgtgcgccgtgctcaaggccgacgcctacggccatggcatcggcctggtgatgccgtcgatcattgcccagggcgtgccctgcgtggcggtggccagtaacgaagaggcccgcgtggtccgcgccagcggcttcaccgggcaactggtgcgggtacgcctggcgagcctcggcgagctggaggacggcttgcagtacgacatggaagagctggtcggcagcgccgaattcgcccgccaggtcgatgccattgccgcacgccatggcaagaccctgcgcattcacatggcgctcaactccagcggcatgagccgcaacggggtagagatgaccacctggtccggccgtggcgaagcgctgcagatcaccgaccagaaacacctcaagctggtcgcgttgatgacccacttcgccgtggaggacaaggacgatgtgcgcaagggcctggcggcgttcaacgaacagaccgactggctgatcgagcacgccaggctcgactgcagtaagctcaccctgcacgcggccaactcgttcgctaccctggaggtgccggaagcgcgcctggacatggtacgtaccggtggcgcgctgttcggtgacaccgtgccggcgcgcaccgaatacaaacgtgccatgcagttcaagtcgcacgtggcagcggtacacagctacccggccggcaacaccgttggctacgaccgcaccttcaccctggcccgggactcgcggctggccaacatcaccgttggctactccgacggctaccgccgggtctttaccaataagggccatgtgctgatcaacggccaccgcgtgccggtggtgggcaaggtctcgatgaacacgctaatggtggatgtcaccgatttccccgacgtgaagggtggcaacgaagtggtgctatttggcaagcaggccggggctgaaataacccaggccgagatggaagaaatcaacgacgcgctgctcgctgacctgtacaccgtatggggcagcgccaacccgaagatgctcgtcgactga

SEQ ID NO: 86 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFSRTLLAASLALLITGQAPLFAAPPLSMDNGTNALTVQNSNAWVEVSASALQRNIRTLQAELGGKSRLCAVLKADAYGHGIGLVMPSIIAQGVPCVAVASNEEARVVRASGFTGQLVRVRLASLGELEDGLQYDMEELVGSAEFARQVDAIAARHGKTLRIHMALNSSGMSRNGVEMTTWSGRGEALQITDQKHLKLVALMTHFAVEDKDDVRKGLAAFNEQTDWLIEHARLDCSKLTLHAANSFATLEVPEARLDMVRTGGALFGDTVPARTEYKRAMQFKSHVAAVHSYPAGNTVGYDRTFTLARDSRLANITVGYSDGYRRVFTNKGHVLINGHRVPVVGKVSMNTLMVDVTDFPDVKGGNEVVLFGKQAGAEITQAEMEEINDALLADLYTVWGSANPKMLVD

SEQ ID NO: 87 - DNA, 1230 bp, Unknown
  Obtained from environmental sample
atgcccttctgccgtacactgctggctgcatccctggccctgctgatcactggccaggccccgctgtacgctgcgccaccgctgtcgatggacaacggcaccgacgccctgaccgtacagaacagcaacgcctgggtcgaagtcagcgccagcgccctgcaacacaacatccgcaccttgcaggccgagctgggcggcaagtccaggctgtgcgccgtgctcaaggccgacgcctatggccatggcatcggcctggtgatgccgtcgatcattgcccagggcgtgccctgcgtggcggtggccagcaacgaagaggcccgtgtggtccgcgccagcggctttaccgggcaactggtgcgggttcgcctggccagcctcagcgagctggaagacgccttgcagtacgacatggaagagctggtcggcagcgccgagttcgcccgccaggtcgatgccattgccgcacgccatggcaagaccctgcgcattcacatggcgctcaactcaagcggcatgagccgcaacggggtggagatgaccacttggtccggccgtggcgaagcgctgcagatcaccgatcagaaacacctcaagctggtcgcgctgatgacccactttgccgtggaggacaaggacgatgtgcgcaacggcctggcggcgttcaacgaacagaccgactggctgatcaagcacgcaaaacttgatcgcagcaagctcaccctgcacgcggccaactcgttcgctaccctggaggtgccggaagcgcgcctggacatggtgcgcaccggtggcgcgctgttcggcgacaccgtgccggcgcgcaccgagtaccagcgcgccatgcagttcaagtcgcacgtggcggcggtgcacagctacccggccggcaacaccgtcggctacgaccgcaccttcaccctggcccgtgactcacgcctggccaacatcaccgtcggctactccgacggctaccgccgggtcttcaccaacaagggccatgtgctgatcaacggccaccgcgtgccggtggtgggcaaggtctcgatgaatacgctgatggtggatgtcaccgatttccccgacgtgaagggtggcaacgaagtggtgctgttcggcaagcaggccggggctgaaataacccaggccgagatggaagaaatcaacgacgcgctgctcgccgacctgtacaccgtatggggcagcgccaacccgaagatgctcgtcgactga

SEQ ID NO: 88 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFCRTLLAASLALLITGQAPLYAAPPLSMDNGTDALTVQNSNAWVEVSASALQHNIRTLQAELGGKSRLCAVLKADAYGHGIGLVMPSIIAQGVPCVAVASNEEARVVRASGFTGQLVRVRLASLSELEDALQYDMEELVGSAEFARQVDAIAARHGKTLRIHMALNSSGMSRNGVEMTTWSGRGEALQITDQKHLKLVALMTHFAVEDKDDVRNGLAAFNEQTDWLIKHAKLDRSKLTLHAANSFATLEVPEARLDMVRTGGALFGDTVPARTEYQRAMQFKSHVAAVHSYPAGNTVGYDRTFTLARDSRLANITVGYSDGYRRVFTNKGHVLINGHRVPVVGKVSMNTLMVDVTDFPDVKGGNEVVLFGKQAGAEITQAEMEEINDALLADLYTVWGSANPKMLVD

SEQ ID NO: 89 - DNA, 1230 bp, Unknown
  Obtained from environmental sample
atgccctttcgccgtaccctcctggctgcatccctggcgctgctgatcactggccaagccccgctgttcgctgccccaccgctgtcgatggacaacggcaccaacgtcctgaccgtgcagaacagcaacgcctgggtcgaagtcagcgccagcgccctgcaacacaacattcgcactttgcaggccgagctgggcggcaagtccaggctgtgcgccgtgctcaaggccgacgcctacggccatggcatcggcctggtgatgccgtcgatcattgcccagggcgtgccctgcgtggcggtggccagcaacgaagaggcccgcgtggtccgcgccagcggctttaccgggcaactggtgcgggttcgcctggccagcctcagcgagctagaggacgccttgcagtacgacatggaagagctggtcggcagcgccgagttcacccgccaggtcgatgccattgccgcacgccatggcaagaccctgcgcattcacatggcgctcaactccagcggcatgagccgcaacggggtggagatgagcacctggtccggccgtggcgaagcgctgcagatcaccgaccagaaacacctcaagctggtcgcgttgatgacccacctcgccgtggaggacaaggacgatgtgcgcaagggcctggcggcgttcaacgaacagaccgaatggctgatcaagcacgccaggctcgaccgcagcaagctcaccctgcacgcggccaactcgttcgctaccctggaggtgccggaagcgcgcctggacatggtacgtaccggtggcgcgctgttcggtgacaccgtgccggcgcgcaccgaatacaaacgtgccatgcagttcaagtcgcacgtggcagcggtacacagctacccggccggcaacaccgttggctacgaccgcaccttcaccctggcccgggactcgcggctggccaacatcaccgttggctactccgacggctaccgccgggtctttaccaacaagggccatgtgctgatcaacggccaccgcgtgccggtggtgggcaaggtctcgatgaacacgctaatggtggatgtcaccgatttccccgacgtgaagggtggcaacgaagtggtgctatttggcaagcaggccggggctgaaataacccaggccgagatggaagaaatcaacgacgcgctgctcgctgacctgtacaccgtatggggcagcgccaacccgaagatgctcgtcgactga

SEQ ID NO: 90 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFRRTLLAASLALLITGQAPLFAAPPLSMDNGTNVLTVQNSNAWVEVSASALQHNIRTLQAELGGKSRLCAVLKADAYGHGIGLVMPSIIAQGVPCVAVASNEEARVVRASGFTGQLVRVRLASLSELEDALQYDMEELVGSAEFTRQVDAIAARHGKTLRIHMALNSSGMSRNGVEMSTWSGRGEALQITDQKHLKLVALMTHLAVEDKDDVRKGLAAFNEQTEWLIKHARLDRSKLTLHAANSFATLEVPEARLDMVRTGGALFGDTVPARTEYKRAMQFKSHVAAVHSYPAGNTVGYDRTFTLARDSRLANITVGYSDGYRRVFTNKGHVLINGHRVPVVGKVSMNTLMVDVTDFPDVKGGNEVVLFGKQAGAEITQAEMEEINDALLADLYTVWGSANPKMLVD

SEQ ID NO: 91 - DNA, 1230 bp, Unknown
  Obtained from environmental sample
atgcccttttgccgtaccctgctggctgcatccctggccctgctgatcactggccaggccccgctgtacgctgcgccaccgctgtcgatggacaacggcaccgacgccctgaccgtacagaacagcaacgcctgggtcgaagtcagcgccagcgccctgcaacacaacatccgcaccttgcaggccgagctgggcggcaagtccaggctgtgcgccgtgctcaaggccgacgcctatggccatggcatcggcctggtgatgccgtcgatcattgcccagggcgtgccctgcgtggcggtggccagcaacgaagaggcccgtgtggtccgcgccagcggctttaccgggcaactggtgcgggttcgcctggccagcctcagcgagctggaagacgccttgcagtacgacatggaagagctggtcggcagcgccgagttcgcccgccaggtcgatgccattgtcgcacgccatggcaagaccctgcgcattcacatggcgctcaactcaagcggcatgagccgcaacggggtggagatgaccacttggtccggccgtggcgaagcgctgcagatcaccgatcagaaacacctcaagctggtcgcgctgatgacccactttgccgtggaggacaaggacgatgtgcgcaacggcctggcggcgttcaacgaacagaccgactggctgatcaagcacgcaaaacttgatcgcagcaagctcaccctgcacgcggccaactcgttcgctaccctggaggtgccggaagcgcgcctggacatggtgcgcaccggtggcgcgctgttcggcgacaccgtgccggcgcgcaccgagtaccagcgcgccatgcagttcaagtcgcacgtggcggcggtgcacagctacccggccggcaacaccgtcggctacgaccgcaccttcaccctggcccgtgactcacgcctggccaacatcaccgtcggctactccgacggctaccgccgggtctttaccaacaagggccatgtgctgatcaacggccaccgcgtgccggtggtgggcaaggtttcgatgaatacgctgatggtggatgtcaccgatttccccgacgtaaagggtggcaacgaagtggtgctgttcggcaagcaggccggggctgaaataacccaggccgagatggaagaaatcaacgacgcgctgctcgccgacctgtacaccgtatggggcagcgccaacccgaagatgctcgtcgactga

SEQ ID NO: 92 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFCRTLLAASLALLITGQAPLYAAPPLSMDNGTDALTVQNSNAWVEVSASALQHNIRTLQAELGGKSRLCAVLKADAYGHGIGLVMPSIIAQGVPCVAVASNEEARVVRASGFTGQLVRVRLASLSELEDALQYDMEELVGSAEFARQVDAIVARHGKTLRIHMALNSSGMSRNGVEMTTWSGRGEALQITDQKHLKLVALMTHFAVEDKDDVRNGLAAFNEQTDWLIKHAKLDRSKLTLHAANSFATLEVPEARLDMVRTGGALFGDTVPARTEYQRAMQFKSHVAAVHSYPAGNTVGYDRTFTLARDSRLANITVGYSDGYRRVFTNKGHVLINGHRVPVVGKVSMNTLMVDVTDFPDVKGGNEVVLFGKQAGAEITQAEMEEINDALLADLYTVWGSANPKMLVD

SEQ ID NO: 93 - DNA, 1230 bp, Unknown
  Obtained from environmental sample
atgccatttcgccgtacccttctggctgcatccctggctctgctgatcactggccaggccccgctgtacgccgcaccgccactgtcgatggacaatggcaccacggccttgaccgtgcagaacagcaacgcctgggtcgaaatcagtgccagcgcgctgcaacacaacatccgtaccttgcaggccgaactgggcggcaagtccaagctgtgcgccgtgctcaaggccgacgcctatggccacggtatcggcctggtgatgccgtcggtcattgcccagggcgtgccctgcgtggcggtggccagcaacgaggaggcccgcgtggtccgcgccagcggcttcaccgggcaactggtgcgggtgcgcctggccagcctcagcgaagtggaagatgccctgcagtacgacatggaagagctggtcggcagcgccgagttcgcccgccagctcgatgccatcgccgagcgccacggcaagaccctgcgcatccacatggcgctcaattccagcggcatgagccgcaacggagtggagatgaccacctggtccggccgtggcgaagcgctgcagatcaccgaccagaagcacctcaagctggtcgcgctgatgacccacttcgccgtggaggacaaggacgatgtgcgcaagggcctggcagcgttcaacgagcagaccgactggctgatcaagcacgcgaaacttgatcgcagcaagctcaccctgcacgccgccaactccttcgctacgctggaagtgccggaagcgcgcctggacatggtgcgcaccggcggcgcgctgttcggcgacacggtgccgacgcacaccgaataccagcgcgccatgcagttcaagtcgcacgtggcggcggtgcacagctacccggccggcaacaccgtcggctacgaccgcaccttcaccctggcgcgtgattcgcgcctggccaacatcaccgtcggttactccgatggctaccgccgggcgttcaccaacaagggccatgtgctgatcaacggccaccgtgtgccggtggtgggcaaggtgtcgatgaacaccttgatggtcgatgtcaccgacttccccgacgtgaagggtggcaacgaagtggtgctgttcggcaaacaggccggggctgaaatcacccaggccgagatggaagaaatcaacggcgcgctgctcgccgacctgtacaccgtatggggcagttccaacccgaagattctcgtcgactga

SEQ ID NO: 94 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFRRTLLAASLALLITGQAPLYAAPPLSMDNGTTALTVQNSNAWVEISASALQHNIRTLQAELGGKSKLCAVLKADAYGHGIGLVMPSVIAQGVPCVAVASNEEARVVRASGFTGQLVRVRLASLSEVEDALQYDMEELVGSAEFARQLDAIAERHGKTLRIHMALNSSGMSRNGVEMTTWSGRGEALQITDQKHLKLVALMTHFAVEDKDDVRKGLAAFNEQTDWLIKHAKLDRSKLTLHAANSFATLEVPEARLDMVRTGGALFGDTVPTHTEYQRAMQFKSHVAAVHSYPAGNTVGYDRTFTLARDSRLANITVGYSDGYRRAFTNKGHVLINGHRVPVVGKVSMNTLMVDVTDFPDVKGGNEVVLFGKQAGAEITQAEMEEINGALLADLYTVWGSSNPKILVD

SEQ ID NO: 95 - DNA, 1230 bp, Unknown
  Obtained from environmental sample
atgccatttccccgtacactgctggctgcatccctggccctgctgatcactggccaggccccactgtacgctgcaccaccgctgtcaatggacaacggcaccaacgccctgaccgtgcagaacagcaacgcctgggtcgaagtcagtgccagcgccctgcaacacaacatccgcaccttgcaggccgagctgggcggcaagtccaggctgtgcgccgtgctcaaggccgacgcctacggccatggcatcggcctggtaatgccgtcgataatcgcccaaggcgtgccctgcgtggcggtggccagtaacgaagaggcccgcgtggtccgcgccagcggctttaccgggcaactggtgcgggtacgcctggccagcctcagcgagctggaagacgccttgcagtacgacatggaggagctggtcggcagcgccgagttcgcccgccaggtcgatgccgttgctgcccgccatggcaaggccctgcgcattcacatggcgctcaactcaagcggaatgagccgcaacggggtggagatgaccacctggtccggccgtggcgaagcgctgcagatcaccgatcagaaacacctcaaactggtcgcgctgatgacccactttgccgtggaggacaaggacgatgtacgcaaaggcctggcggggttcaacgaacagaccgactggctgatcaagcacgccgggctcgaccgcagcaagcttaccctgcacgcggccaactcgttcgccacgctagaggtgccggaagcgcgcctggacatggtacgcacggggggcgcgctgttcggtgacaccgtgccggagcgcaccgaatacaaacgtgccatgcagttcaagtcgcacgtggcagcggtacacagttacccggccggcaacaccgttggctacgaccgcaccttcaccctggcacgtgactcgcggctggccaacatcaccgtcggttactccgacggctaccgccgggtcttcaccaacaagggccatgtgctgatcaacgggcaccgcgtgccggtggtgggcaaggtctcgatgaatacgctgatggtggatgtcaccgatttccccgacgtgaaagatggcaacgaagtggtgctgttcggcaagcaggccggggctgaaataacccagaccgagatggaagaaatcaacgacgcgctgctcgccgacctgtacaccgtatggggcagcgccaacccgaagatgctcgtcgactga

SEQ ID NO: 96 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFPRTLLAASLALLITGQAPLYAAPPLSMDNGTNALTVQNSNAWVEVSASALQHNIRTLQAELGGKSRLCAVLKADAYGHGIGLVMPSIIAQGVPCVAVASNEEARVVRASGFTGQLVRVRLASLSELEDALQYDMEELVGSAEFARQVDAVAARHGKALRIHMALNSSGMSRNGVEMTTWSGRGEALQITDQKHLKLVALMTHFAVEDKDDVRKGLAGFNEQTDWLIKHAGLDRSKLTLHAANSFATLEVPEARLDMVRTGGALFGDTVPERTEYKRAMQFKSHVAAVHSYPAGNTVGYDRTFTLARDSRLANITVGYSDGYRRVFTNKGHVLINGHRVPVVGKVSMNTLMVDVTDFPDVKDGNEVVLFGKQAGAEITQTEMEEINDALLADLYTVWGSANPKMLVD

SEQ ID NO: 97 - DNA, 1230 bp, Unknown
  Obtained from environmental sample
atgccatttcgccgtacactgctggctgcatccctggccctgctgatcactggccaggccccactgtacgctgcaccaccgctgtcaatggacaacggcaccaacgccctgaccgtgcagaacagcaacgcctgggtcgaagtcagtgccagcgccctgcaacacaacatccgcaccttgcaggccgagctgggcggcaagtccaggctgtgcgccgtgctcaaggccgacgcctacggccatggcatcggcctggtaatgccgtcgataatcgcccaaggcgtgccctgcgtggcggtggccagtaacgaagaggcccgcgtggtccgcgccagcggctttaccgggcaactggtgcgggtacgcctggccagcctcagcgagctggaagacgccttgcagtacgacatggaggagctggtcggcagcgccgagttcgcccgccaggtcgatgccgttgctgcccgccatggcaagaccctgcgcattcacatggcgctcaactcaagcggaatgagccgcaacggggtggagatgaccacctggtccggccgtggcgaagcgctgcagatcaccgatcagaaacatctcaaactggtcgcgctgatgacccactttgccgtggaggacaaggacgatgtacgcaaaggcctggcggggttcaacgaacagaccgactggctgatcaagcacgccgggctcgaccgcagcaagcttaccctgcacgcggccaactcgttcgccacgctagaggtgccggaagcgcgcctggacatggtacgcacggggggcgcgctgttcggtgacaccgtgccggagcgcaccgaatacaaacgtgccatgcagttcaagtcgcacgtggcagcggtacacagttacccggccggcaacaccgttggctacgaccgcaccttcaccctggcacgtgactcgcggctggccaacatcaccgtcggttactccgacggctaccgccgggtcttcaccaacaagggccatgtgctgatcaacgggcaccgcgtgccggtggtgggcaaggtctcgatgaatacgctgatggtggatgtcaccgatttccccgacgtgaaagatggcaacgaagtggtgctgttcggcaagcaggccggggctgaaataacccagaccgagatggaagaaatcaacgacgcgctgctcgccgacctgtacaccgtatggggcagcgccaacccgaagatgctcgtcgactga

SEQ ID NO: 98 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFRRTLLAASLALLITGQAPLYAAPPLSMDNGTNALTVQNSNAWVEVSASALQHNIRTLQAELGGKSRLCAVLKADAYGHGIGLVMPSIIAQGVPCVAVASNEEARVVRASGFTGQLVRVRLASLSELEDALQYDMEELVGSAEFARQVDAVAARHGKTLRIHMALNSSGMSRNGVEMTTWSGRGEALQITDQKHLKLVALMTHFAVEDKDDVRKGLAGFNEQTDWLIKHAGLDRSKLTLHAANSFATLEVPEARLDMVRTGGALFGDTVPERTEYKRAMQFKSHVAAVHSYPAGNTVGYDRTFTLARDSRLANITVGYSDGYRRVFTNKGHVLINGHRVPVVGKVSMNTLMVDVTDFPDVKDGNEVVLFGKQAGAEITQTEMEEINDALLADLYTVWGSANPKMLVD

SEQ ID NO: 99 - DNA, 1230 bp, Unknown
  Obtained from environmental sample
atgccattttgccgtacactactggccgcatcgctggccctgctgatcactggccaggccccgctgtacgccgcaccgccgttgtcgatggacaacggcaccaacgccttgaccgtgcaaaacagcaatgcctgggtcgaagtcagcgccagcgccctgcaacacaacatccgtaccctgcaggccgaactggccggcaagtccaagctgtgcgccgtgctcaaggccgacgcctatggccatggtatcggcctggtgatgccgtcgatcatcgcccagggcgtgccctgcgtggcggtggccagcaacgaggaggcccgcgtggtccgcgccagtggcttcaccgggcaactggtgcgggtacgcctggccagcctcagcgagctggaagacgccttgcagtacgacatggaagagctggtgggcagcgccgaatttgcccgccaggtcgatgccatcgccgcgcgccacggcaagaccctgcgtattcacatggcgctcaactccagcggcatgagccgcaacggggttgagatgaccacctggtccggccgtggcgaagcgctgcagatcaccgaccagaagcacctcaagctggtcgcgctgatgacccacttcgccgtggaagacaaggacgacgtacgcaagggcctggcggccttcaacgagcaggccgactggttgatcaagcacgcaaaactcgaccgcagcaagctcaccctgcacgccgccaactcgttcgcaaccctggaggtgccggaggcgcgtctggacatggtacgcaccggtggcgcgctgttcggtgataccgtgccagcgcgcaccgagtacaaacgcgccatgcagttcaagtcgcatgtggcggcggtgcacagttacccggccggcaacaccgtcggctacgaccgcaccttcaccctggcccgtgattcgcgcctggccaacatcaccgtcggctattccgatggctatcgccgggtgttcaccaacaaggggcatgtgctgatcaacggccaccgcatcccggtggtgggcaaggtgtcgatgaacacgctgatggtcgatgtcaccgactttccgggcgtgaagggtggcaacgaagtggtgctgttcggcacgcaggccgggggtgaaatcactcaggccgaaatagaggaaatcaacggcgcgctgctggccgacctgtacaccgtgtggggcaattccaacccgaagattctcgtcgactga

SEQ ID NO: 100 - protein, 409 aa, Unknown
  Obtained from environmental sample
  SIGNAL (1)...(24)
  DOMAIN (43)...(272): Alanine racemase, N-terminal domain
  DOMAIN (280)...(408): Alanine racemase, C-terminal domain
  SITE (32)...(35): N-glycosylation site. Prosite id = PS00001
  SITE (73)...(83): Alanine racemase pyridoxal-phosphate attachment site. Prosite id = PS00395
  SITE (170)...(173): N-glycosylation site. Prosite id = PS00001
  SITE (319)...(322): N-glycosylation site. Prosite id = PS00001
MPFCRTLLAASLALLITGQAPLYAAPPLSMDNGTNALTVQNSNAWVEVSASALQHNIRTLQAELAGKSKLCAVLKADAYGHGIGLVMPSIIAQGVPCVAVASNEEARVVRASGFTGQLVRVRLASLSELEDALQYDMEELVGSAEFARQVDAIAARHGKTLRIHMALNSSGMSRNGVEMTTWSGRGEALQITDQKHLKLVALMTHFAVEDKDDVRKGLAAFNEQADWLIKHAKLDRSKLTLHAANSFATLEVPEARLDMVRTGGALFGDTVPARTEYKRAMQFKSHVAAVHSYPAGNTVGYDRTFTLARDSRLANITVGYSDGYRRVFTNKGHVLINGHRIPVVGKVSMNTLMVDVTDFPGVKGGNEVVLFGTQAGGEITQAEIEEINGALLADLYTVWGNSNPKILVD

SEQ ID NO: 101 - DNA, 381 bp, Unknown
  Obtained from environmental sample
atgacccgccctatactggccagccttgacctgcaggcgatgaaacaaaacctgagcattgtgcgtcaggccgcaccggacgcccgcgtctggtcagtggtgaaagccaatgcttatggacatggcatagaacgtatctggagtgcgctgggcaacaccgacggttttgcccttttgaatctggaagaggcggtcaccttgcgtgagcgcggctggaaagggccgatcctgatgctggaaggttttttccacgccgacgatctggaacggtacgatacctggcgtctgaccacctgcgttcacagcaactggcagttgaaagcgatccagaatgcgaagctgaaagcgccgctggatgtttatgtactcgtgccgaattct

SEQ ID NO: 102 - protein, 127 aa, Unknown
  Obtained from environmental sample
  DOMAIN (4)...(127): Alanine racemase, N-terminal domain
  SITE (17)...(20): N-glycosylation site. Prosite id = PS00001
  SITE (32)...(42): Alanine racemase pyridoxal-phosphate attachment site. Prosite id = PS00395
MTRPILASLDLQAMKQNLSIVRQAAPDARVWSVVKANAYGHGIERIWSALGNTDGFALLNLEEAVTLRERGWKGPILMLEGFFHADDLERYDTWRLTTCVHSNWQLKAIQNAKLKAPLDVYVLVPNS

SEQ ID NO: 103 - DNA, 714 bp, Unknown
  Obtained from environmental sample
atgaaaaataacaaatgtatagcaattcttggtggtatgggacctcaagcttcatcaaagcttttagaggtcatgatttctatggcaacaaaggattttggaattaaaaatgattcagattttcctgaaataattcttgattcaatacctgttcccaacttcatatctaataaggaaaactctaaaccagccttagatgtactcagaagtagagtgaagaggttggaagtttttgagccattttcttttgcaattgcttgcaatacggctcacttactattaaatgaccttcaaaaaacgactagagttccttttatatccattattgagcaagttgcaaataaagtaagtgagaagagaattaagaaagttggattattagcaactcccatcacgattgaatcaaatctttaccagtccatgctcaaaaaacataaagtcgaagtaattgatcctacaaaaatggatagaattaagctggatacaataatcagaagagtaattgcaggtaaaaccaagcctatagattctctcatgcttcttgtcattgctaaaaaattaaaaagcaaaggcgcagaaggaataattcttggatgtacagaaatacctttaatcttcccaaaagataggtttgaaatccccatttttgattctgttgaaatactagccgaagcattattgcaaaaaatggtgaaaggaggtgaatatatatga

SEQ ID NO: 104 - protein, 237 aa, Unknown
  Obtained from environmental sample
  SIGNAL (1)...(19)
  DOMAIN (6)...(231): Asp/Glu/Hydantoin racemase
  SITE (37)...(40): N-glycosylation site. Prosite id = PS00001
  SITE (85)...(93): Aspartate and glutamate racemases signature 1. Prosite id = PS00923
MKNNKCIAILGGMGPQASSKLLEVMISMATKDFGIKNDSDFPEIILDSIPVPNFISNKENSKPALDVLRSRVKRLEVFEPFSFAIACNTAHLLLNDLQKTTRVPFISIIEQVANKVSEKRIKKVGLLATPITIESNLYQSMLKKHKVEVIDPTKMDRIKLDTIIRRVIAGKTKPIDSLMLLVIAKKLKSKGAEGIILGCTEIPLIFPKDRFEIPIFDSVEILAEALLQKMVKGGEYI

SEQ ID NO: 105 - DNA, 1002 bp, Unknown
  Obtained from environmental sample
atgaaacaaacttttttttgtatagatgcacatacatgcggtaatccggtcaggttggttaaagaaggcgggccgctgttgacgggaaagaacatgagtgaaaagcggcagcatttcctgaaagaatatgactggataagaacaggattgatgtttgaaccaagaggtcatgatatgatgagcggaagcattttatacccgccacatgatccttcaaatgatgtagcagtattatttattgaaacaagcggatgcctgccaatgtgcggacatggaacgattggaacgataacgatcgctattgaagaaggattgatacagccgaaaacggaaggtgttgttagaatggaaacgccggcggggttagttaacgtagaattcaaaagtcaaaatgaaaaagtaaaaagcgtaaagcttaccaatgttccttcatttctttattcaacagatttagttgctgattgtcctgagctgggtgaattagttatcgatgtttcttacggtggaaatttttatgcaatcgttgatgtacaaaaaaattttaaagggcttgaacattatcctgctgataaattaattgcctgggcaagagagctgcggaagaatatcaatgcgaaatatgaatttgtacatcccgacgatccgacaatcaatcgttgttcgcatattttatggacgggagctgtaattgataaaacatcgaccgcacgtaatgcggtattttatggcgataaagcaatagatcgttcgccatgtggtacaggtacaagtgcaagaatggcgcaatggtatgcaaaaggaaaattaaaaaagggagatcagttcattcacgaaagtattatcggaagcaaattcatcggaacgattgaagaagaaacgatgataggagataagcccgctatacgtccgggaatagaaggctgggcaaagatatacggacgcaatacgataactatcgatactgaggatgatccgtatgctcatgggttccaggttatttaa

SEQ ID NO: 106 - protein, 333 aa, Unknown
  Obtained from environmental sample
  DOMAIN (7)...(331): Proline racemase
  SITE (31)...(34): N-glycosylation site. Prosite id = PS00001
MKQTFFCIDAHTCGNPVRLVKEGGPLLTGKNMSEKRQHFLKEYDWIRTGLMFEPRGHDMMSGSILYPPHDPSNDVAVLFIETSGCLPMCGHGTIGTITIAIEEGLIQPKTEGVVRMETPAGLVNVEFKSQNEKVKSVKLTNVPSFLYSTDLVADCPELGELVIDVSYGGNFYAIVDVQKNFKGLEHYPADKLIAWARELRKNINAKYEFVHPDDPTINRCSHILWTGAVIDKTSTARNAVFYGDKAIDRSPCGTGTSARMAQWYAKGKLKKGDQFIHESIIGSKFIGTIEEETMIGDKPAIRPGIEGWAKIYGRNTITIDTEDDPYAHGFQVI

SEQ ID NO: 107 - DNA, 1227 bp, Unknown
  Obtained from environmental sample
atgcacaagaagacactgcttgccaccttgatcctgggcctgctggccggtcaggccgtcgccgcgccctacctgccgctggcaaacgatcatcgcaatggcgacgtacaaaccgccagcaatgcctggctggaagtcgacctgaccgccttcgagcacaatatccagaccctcaaggatcgcctcggtgacaagggcccgcagatctgcgccatcatgaaggctgacgcatatggtcacggcatcgacctgctggtcccctccgtggtcaaggccaatatcccctgcatcggcattgccagcaacgaagaggctcgcgtggcgcgcgagaagggcttcaccggccgcctgatgcgagtgcgttcagccactccggacgaagtggagcaggccctgccctacaagatggaagagctgatcggcagcctggtgagcgcccagggcatcgccgacatcgcccagcgtcaccataccaatatcccggtgcacataggtctcaactccgccggcatgagccgcaacggcatcgacctgcgtctggcggactccaaggcagatgcgctggccatgctcaagctcaaggggatcacccctgtcggcatcatgacccacttcccggtggaagagaaagaggacgtcaagctgggactggcccagttcaagctggactcccagtggctgatcgaggcgggcaagctggatcgcagcaagctcaccatccacgcggccaactccttcgccaccctggaagtgccggacgcctacttcgacatggtgcgcccgggcggcctgctctacggtgactccatcccctcctacaccgaatacaagcgggtcatggcgttcaagacccaggtggcctcggtcaaccactacccggctggcaataccgtaggctatgaccgcaccttcactctcaaacgtgactcctggctcgccaacctgccgctgggatactccgacggctaccgccgtgcgctcagcaacaaggcctatgtgctgatccagggtcagaaagtgcctgtggtcggcaaaacctccatgaacaccatcatggtggacgtgaccgatctgaaaggggtgaagcccggcgatgaagtggtgctgtttggccgtcagggtgaggccgaggtgaagcaggcggatctggaggagtacaacggtgccctgctggcggatatgtacaccatctggggctacaccaaccccaagaagatcaaccgctaa

SEQ ID NO: 108 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPLANDHRNGDVQTASNAWLEVDLTAFEHNIQTLKDRLGDKGPQICAIMKADAYGHGIDLLVPSVVKANIPCIGIASNEEARVAREKGFTGRLMRVRSATPDEVEQALPYKMEELIGSLVSAQGIADIAQRHHTNIPVHIGLNSAGMSRNGIDLRLADSKADALAMLKLKGITPVGIMTHFPVEEKEDVKLGLAQFKLDSQWLIEAGKLDRSKLTIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 109 - DNA, 1227 bp, Unknown
  Obtained from environmental sample
atgcacaagaagacactgctcgctaccctgatcttcggcctgctcgcgggccaagccgttgcggctccctatctgccccttgtgacggatcatcgcagcggccaggagcaaaccgccagcaacgcctggttggaagtggatctgggcgcctttgagcacaatatccagaccctcaaggatcgcctcggcgacaagggcccgcagatctgcgccatcatgaaggccgacgcttacggtcatggcatcgacctgctggtcccctccgtggtcaaggccaatatcccctgcatcggcatcgccagcaacgaagaggcgcgcgtcgcccgcgagaagggctttaccggccgtctgatgcgggtgcgtgctgccaccccggatgaagtagagcaggccctgccctacaagatggaggagctgatcggcagtctggtgagtgcccagggtatcgccgatatcgcccagcgccaccacaccaccattccggtgcatatcgcgctcaactccgccggcatgagccgcaacggcatcgacctgcgtctggccgatgccaagcaggatgcgctggccatgctcaagctaaaggggatcaccccggtcggcatcatgacccacttcccggttgaggagaaagaggacgtcaagatggggctggcccagttcaaactggactcccagtggctgctggaagcgggcaaactggatcgcagcaagatcaccatccacgccgccaactccttcgccactctggccgtgccggacgcctacttcgacatggtgcgcccgggcggcctgctctacggtgactccatcccctcccacaccgagtacaagcgggtgatggcattcaagacccaggtcgcctcggtcaaccactatgccgcgggcaacaccgtcggttatgaccgcacctttaccctcaagcgtgactcctggctcgccaacctgccgctgggctactccgatggctatcgccgcgccctcagcaacaaagcctatgtgctgatcaagggtcagaaggtgccggtggtcggcaagacttccatgaacaccatcatggtggatgtgactgatctgaaaggggtgaaacccggtgacgaggtggtgctgtttggccgtcagggtgaaaccgaagtgaaacaggcggatctggaggagtacaacggcgccctgctggcggacatgtacaccatctggggctacaccaaccccaagaagatcaaccgctaa

SEQ ID NO: 110 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLIFGLLAGQAVAAPYLPLVTDHRSGQEQTASNAWLEVDLGAFEHNIQTLKDRLGDKGPQICAIMKADAYGHGIDLLVPSVVKANIPCIGIASNEEARVAREKGFTGRLMRVRAATPDEVEQALPYKMEELIGSLVSAQGIADIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHYAAGNTVGYDRTFTLKRDSWLANLPLGYSDGYRRALSNKAYVLIKGQKVPVVGKTSMNTIMVDVTDLKGVKPGDEVVLFGRQGETEVKQADLEEYNGALLADMYTIWGYTNPKKINR

SEQ ID NO: 111 - DNA, 1227 bp, Unknown
  Obtained from environmental sample
atgcacaagaagacactgcttgccaccctgatcctgggcctgctggccggtcaggccgtcgcggccccttacctgccgctggccagcgatcatcgcaacggcgaagtgcagaccgccagcaatgcctggctggaagtcgatctcggcgccttcgagcacaacatccagaccctcaaggatcgcctcggtgacaaagggccgaagatctgcgccatcatgaaggccgacgcctacggccacggcatcgacctgctggtcccctcggtggtcaaggccggtatcccctgcatcggcatcgccagcaacgaagaggcccgcgtggcccgcgagaagggcttcaccggccgcctaatgcgggtgcgtgccgccaccccggccgaagtggagcaggccctgccctacaagatggaagaactcatcggcagcctggtgagtgcccagggcatcgccgacatcgcccagcgccaccacaccaatatcccggtgcacatcgcgctcaactccgccggcatgagccgcaacggcatcgatctgcgtctggctgactccaagaaagacgcgctggccatgctcaagctcaaggggatcaccccggtcggcatcatgacccacttcccggtggaggagaaagaggacgtcaagatggggctggcccagttcaagctggactcccagtggctgccggaagcgggcaagctggatcgcagcaagatcaccatccacgccgccaactccttcgccaccctggaagtgccggacgcctacttcgacatggtgcgcccgggtggcctgctgtacggcgactccatcccctcctacaccgagtacaagcgggtgatggcgttcaagacccaggttgcctccgtcaaccactacccggccggcaacaccgtcggttatgaccgcaccttcaccctcaagcgcgactcctggctcgccaacctgccgctgggctactccgacggctatcgccgggcgctgagcaacaaggcctatgtgctgatccagggccagaaggtgccggtggtgggcaagacctccatgaacaccatcatggtggacgtgaccgatctcaagggagtcaaacccggtgacgaggtggtgctgttcggccgccagggtgaagccgaggtgaaacaggcggatctcgaggagtacaacggcgccctgctggcggacatgtacaccatctggggctacaccaaccccaagaagatcaaacgctaa

SEQ ID NO: 112 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKGPKICAIMKADAYGHGIDLLVPSVVKAGIPCIGIASNEEARVAREKGFTGRLMRVRAATPAEVEQALPYKMEELIGSLVSAQGIADIAQRHHTNIPVHIALNSAGMSRNGIDLRLADSKKDALAMLKLKGITPVGIMTHFPVEEKEDVKMGLAQFKLDSQWLPEAGKLDRSKITIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 113 - DNA, 1221 bp, Unknown
  Obtained from environmental sample
atgcacaagaagacactgcttgcgaccctggtcttcgggttgctcgccggccaggccgtcgccgccccctatctgcccctggccagcgacacccgcaacggtcaggagcagaccgccgccaacgcctggctggaggtggacttgaccgccttcgagcacaacatccagaccctcaaggatcgtctcggcgacaagggcccgcagatctgcgccatcatgaaggccgacacctacggtcacggcatcgatctgctggtcccctccgtggtcaaggcgggcattccctgcatcggcatcgccagcaatgaagaggcccgcgtggcccgcgagaagggcttcgagggccgcctgatgcgggtccgtgccgccaccccggccgaagtggagcaggccctgccctacaagctggaagagctggtcggcagcctggagagcgccaaggggatcgccgacatcgcccagcgcaaccataccaacattccggtgcacataggtctgaactccgccggcatgagccgcaacggcatcgacctgcgccaggcaaacgccaaggaagatgccctggccatggtcaagctcaaggggatcaccccggtcggcatcatgacccacttcccggtggaagagaaagaggacgtcaagctggggctggcccagttcaagctggactaccagtggctgatcgatgcgggcaagctggatcgcagcaagctcaccatacacgccgccaactccttcgccaccctggaagtgccggaagcctactttgacatggttcgcccgggcggcatcatctacggtgacaccatcccctcctacaccgaatacaagaaggtgatggcgttcaagacccaggtcgcctcggtaaaccactacccggcgggcaacaccgtcggctatgaccgcaccttcaccctcaagcgtgactccctgctcgccaacctgccgctgggttactccgacggctaccgccgtgcgctgagcaacaaggcctatgtgctgatccagggccagaaggtgcccgtggtgggcaagacctccatgaacaccatcatggtggacgtgaccgatctcaaaggggtgaaacccggtgacgaggtggtgctgttcggccgtcagggtgaggccgaggtgaagcaggcggatctggaggagtacaacggcgccctgctggcggacatgtacaccatctggggttacaccaaccccaagaagatcaag

SEQ ID NO: 114 - protein, 407 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (158)...(161): N-glycosylation site. Prosite id = PS00001
MHKKTLLATLVFGLLAGQAVAAPYLPLASDTRNGQEQTAANAWLEVDLTAFEHNIQTLKDRLGDKGPQICAIMKADTYGHGIDLLVPSVVKAGIPCIGIASNEEARVAREKGFEGRLMRVRAATPAEVEQALPYKLEELVGSLESAKGIADIAQRNHTNIPVHIGLNSAGMSRNGIDLRQANAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIK

SEQ ID NO: 115 - DNA, 1227 bp, Unknown
  Obtained from environmental sample
atgcacaagaagacactgctggccaccctcgtcttcggcctgctggccggccaggcggtcgcagccccctacctgccgctcgccagcgacacccgcaacggtcaggagcagaccgccaccaacgcctggctggaagttgatctgggcgccttcgagcacaacatccagaccctcaaggatcgcctcggtgacaagggcccgcagatctgcgccatcatgaaggcggacgcctacggtcacggcatcgatctgctggtgccctcggtggtcaaggccaacattccctgcatcggcatcgccagcaacgaagaggcccgcgtggcccgtgagaagggcttcgaaggccggctgatgcgggtccgtgccgccaccccgaccgaggtggagcaggccctgccctacaaactagaagagctcatcggcagcctggagagtgccaagggcatctccgacatcgccctgcgccacaacaccaaagtgccggtgcaccttggcttgaactccgccggcatgagccgcaacggcatcgacttgcgccaggccggcgccaaggaagagaccctggccatgctcaagctgccgggcatcaccccggtcggcatcatgacccacttcccggtggaggagaaagaggacgtcaagctgggcctggcccagttcaagctggacagccagtggctgctggaagcgggcaagctggatcgcagcaaaatcaccatccatgccgccaactccttcgccaccctggaagtgcctgacgcctacttcgacatggtgcgcccgggcggcctgctgtacggcgactccatcccctcctacaccgagtacaagcgcgtcatggcgttcaagacccaggtcgcctcggtcaaccactacccggccggcaacaccgtcggctatgaccgcacctttaccctcaagcgcgactccctgctggcgaacctgccgctgggttactccgacggctatcgccgcgcgctcagcaacaaggcctatgtgttgatccagggtcagaaggtgcctgtggtcggcaagacctccatgaacaccatcatggtggacgtgactgatctgaagggagtgaaacccggtgacgaggtggtgctgttcggccgccagggcaaggccgaggtgaaacaggcggatctggaggagtacaacggcgccctgctggcggacatgtacaccatctggggctacaccaaccccaagaagatcaatcgctga

SEQ ID NO: 116 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTATNAWLEVDLGAFEHNIQTLKDRLGDKGPQICAIMKADAYGHGIDLLVPSVVKANIPCIGIASNEEARVAREKGFEGRLMRVRAATPTEVEQALPYKLEELIGSLESAKGISDIALRHNTKVPVHLGLNSAGMSRNGIDLRQAGAKEETLAMLKLPGITPVGIMTHFPVEEKEDVKLGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGKAEVKQADLEEYNGALLADMYTIWGYTNPKKINR

SEQ ID NO: 117 - DNA, 1227 bp, Unknown
  Obtained from environmental sample
atgcacaagaagacactgctagccaccctcgtcttcggcctgctggccggccaggcggtcgccgccccctacctgccgctcgccagcgacacccgcaacggtcaggagcaaaccgccgccaacgcctggctggaagtggatctgggcgccttcgagcacaacatccagaccctcaaggatcgcctcggtgacaagggcccgcagatctgcgccatcatgaaggcggacgcctacggtcacggcatcgatctgctggtgccctcggtggtcaaggccaacatcccctgcatcggcatcgccagcaacgaagaggcccgggtggctcgggagaaaggcttcgaaggccgactgatgcgggtccgtgccgccaccccgaccgaggtggagcaggccctgccctacaagctcgaagagctcatcggcagcctggagagtgccaagggcatctccgacatcgccctgcgccacagcaccaaggtgccggtgcacatcggtctgaactccgccggcatgagccgcaacggcatcgacctgcgccagtccggcgccaaggacgaggccctgaccatgctcaagctgccgggcatcaccccggtcggcatcatgacccacttcccggtggaggagaaagaggacgtcaagctgggtctggcccagttcaagctggacagccagtggctgctggaagcgggcaagctggatcgcagcaagatcaccatccatgccgccaactccttcgccactctggaagtgcctgacgcctacttcgacatggtgcgcccgggcggcctgctgtacggcgactccatcccctcctacaccgagtacaagcgcgtgatggcgttcaagacccaggtcgcctcggtcaaccactacccggccggcaacaccgtcggctatgaccgcaccttcaccctcaagcgtgactccctgctggcgaacctgccgctcggttactccgacggttatcgccgcgcgctcagcaacaaggcctatgtgctgatccagggtcagaaggtgcctgtggtcggcaagacctccatgaacaccatcatggtggacgtgaccgacctgaagggagtgaaacccggtgacgaggtggtgctgtttggccgccagggagaggccgaggtgaaacaggcggatctggaggagtacaacggcgccctgctggcggacatgtacaccatctggggctacaccaaccccaagaagatcaaccgctga

SEQ ID NO: 118 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLGAFEHNIQTLKDRLGDKGPQICAIMKADAYGHGIDLLVPSVVKANIPCIGIASNEEARVAREKGFEGRLMRVRAATPTEVEQALPYKLEELIGSLESAKGISDIALRHSTKVPVHIGLNSAGMSRNGIDLRQSGAKDEALTMLKLPGITPVGIMTHFPVEEKEDVKLGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 119 - DNA, 1227 bp, Unknown
  Obtained from environmental sample
atgcacaagaagacactgctagccaccctcgtcttcggcctgctggccggccaggcggtcgccgccccctacctgccgctcgccagcgacacccgcaacggtcaggagcaaaccgccgccaacgcctggctggaagtggatctgggcgccttcgagcacaacatccagaccctcaaggatcgcctcggtgacaagggcccgcagatctgcgccatcatgaaggcggacgcctacggtcacggcatcgatctgctggtgccctcggtggtcaaggccaacatcccctgcatcggcatcgccagcaacgaagaggcccgcgtggcccgcgagaagggctttaccggccgcctgatgcgggtgcgctctgccaccccggacgaagtggagcaggccctgccctacaagatggaagagctgatcggcagcctggtgagcgcccagggcatagccggcatcgcccagcgtcaccataccaatatcccggtgcacataggtctcaactccgccggcatgagccgcaacggcatagacctgcgtctggcggactccaaggccgatgcgctggccatgctcaagctcaaggggatcaccccggtcggcatcatgacccacttcccggtggaagagaaagaggacgtcaagctggggctggcccagttcaagctggactcccagtggctgatcgaggcgggcaagctggatcgcagcaagctcaccatccacgccgccaactccttcgccaccctggaagtgccggatgcctacttcaacatggtgcgcccgggcggcctgctctacggcgactccatcccctcctacaccgaatacaagcgggtcatggcgttcaagacccaggtcgcctccgtcaaccactacccggccggcaataccgtcggttatgaccgcaccttcaccctcaagcgcgactcctggctcgccaacctgccgctgggttactccgacggctaccgccgtgcactcagcaacaaggcctatgtgctggtccagggtcagaaagtgcccgtggtcggcaagacctccatgaacaccatcatggtggacgtgaccgatctgaaaggggtgaaacccggcgacgaggtggtgctgtttggccgtcagggcgaggccgaggtgaagcaggcggatctggaggagtacaacggcgccctgctggcggacatgtacaccatctggggctacaccaaccccaagaagatcaaccgctga

SEQ ID NO: 120 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLGAFEHNIQTLKDRLGDKGPQICAIMKADAYGHGIDLLVPSVVKANIPCIGIASNEEARVAREKGFTGRLMRVRSATPDEVEQALPYKMEELIGSLVSAQGIAGIAQRHHTNIPVHIGLNSAGMSRNGIDLRLADSKADALAMLKLKGITPVGIMTHFPVEEKEDVKLGLAQFKLDSQWLIEAGKLDRSKLTIHAANSFATLEVPDAYFNMVRPGGLLYGDSIPSYTEYKRVMAFKTQVASVNHYPAGNTVGYDRTFTLKRDSWLANLPLGYSDGYRRALSNKAYVLVQGQKVPVVGKTSMNTIMVDVTDLKGVKPGDEVVLFGRQGEAEVKQADLEEYNGALLADMYTIWGYTNPKKINR

SEQ ID NO: 121 - DNA, 1083 bp, Unknown
  Obtained from environmental sample
agcaatgcctgggtggaaatcgatcaggcggcgttcgagcacaatattcgcaccttgcagaccctgctcgacggcaagtcgcagatctgtgccatcatgaaggccgacgcctacggccatggcatcgccaacctgatgccctcggtgatggccgccaatatcccctgcatcggcattaccagcaacgaagaagcccgagtggtgcgggaaagcggctatcaagggcgcatcatgcgggtacgcagcgccacgccggcggaagtaagcgatggtctgcaatacgagatggaggagctgttcggcgatatcgaggcggcccgccaggcggccgaggtggccaaggccgccggcaagaccctgcgttatcacctgggcctgaatgccggcggcatgagccgcaacggcctggaagtggcgaccgaagccggcaagcaggaagcccgcgagctgctggcgcaggagaatctggaactggtcggcattatgacccatttccagtatgaagacgcggacttcgtgcgcgccgggctggccaaattcaatgaacagtctaagtggctgatcgaagacggcaagctggatcgcagcaagctgaccctgcatgcggccaactccttcaccaccctggaagtgccggaagcccggctggatatggttcgccccggcggcatcatctatggcgacaccattccttcctataccgaatacaagaaggtgatgtcgttcaagacccgggtggcgtcggtcaacaactacccggccggcagcctggtgggctatgacggcacctataccctggagcgggattcactgctggccaacctgccgatgggctattccgacggttaccgccgggtgttcaccaacagggcctatgtggtggtcaacggccagcgggcgccggtggtgggcaaggtgtcgatgaacaccaccatgatcgatgtgaccgatattccgggcgtcaagccgggggatgaagtggtgctgttcggcaagcagggcggggcggaagtcacccagggcgagctggaagacgccaacggcgccctgctggcggacctgtacaccgtctggggctacgcc

SEQ ID NO: 122 - protein, 361 aa, Unknown
  Obtained from environmental sample
  DOMAIN (2)...(232): Alanine racemase, N-terminal domain
  DOMAIN (239)...(356): Alanine racemase, C-terminal domain
  SITE (31)...(41): Alanine racemase pyridoxal-phosphate attachment site. Prosite id = PS00395
  SITE (313)...(316): N-glycosylation site. Prosite id = PS00001
SNAWVEIDQAAFEHNIRTLQTLLDGKSQICAIMKADAYGHGIANLMPSVMAANIPCIGITSNEEARVVRESGYQGRIMRVRSATPAEVSDGLQYEMEELFGDIEAARQAAEVAKAAGKTLRYHLGLNAGGMSRNGLEVATEAGKQEARELLAQENLELVGIMTHFQYEDADFVRAGLAKFNEQSKWLIEDGKLDRSKLTLHAANSFTTLEVPEARLDMVRPGGIIYGDTIPSYTEYKKVMSFKTRVASVNNYPAGSLVGYDGTYTLERDSLLANLPMGYSDGYRRVFTNRAYVVVNGQRAPVVGKVSMNTTMIDVTDIPGVKPGDEVVLFGKQGGAEVTQGELEDANGALLADLYTVWGYA

SEQ ID NO: 123 - DNA, 1083 bp, Unknown
  Obtained from environmental sample
agcaatgcctgggtggagatagacctgggtgcgtttgagcacaacctccagaccctcaagacccgcctcggcgacaagggaccgcagatctgcgccatcatgaaggccgatgcctacggtcacggcatcgatctgctggtcccctccgtggtcaaggcgggcatcccctgcatcggcatcgccagcaatgaagaggcccgcgtcgcccgcgagaagggcttcgaaggccgcctgatgcgggtgcgcgccgccaccccggatgaagtggagcaggccctgccctatcggctggaagagctggtgggcagcctggtgagcgcccaagggatctccgacatcgcattgcgtcacaacacccggatcccggtgcacatcggcctcaactccgccggcatgagccgcaacggcatcgacctgagggccgaggatgccaagggcgaggccctctccatgctggcgctcaaggggatcaccccggtcggcatcatgacccacttcccggtggaggagaaagaggacgtcaagctggggctggcccagttcaagctggacacccagtggctcatcgaggcgggcaagctggatcgcagcaagctcaccatccacgccgccaactccttcgccactctggagctgccggaagcctactttgacatggtgcgcccgggcggcatcatctatggcgataccatcccctcctacaccgaatacaagaaggtgatggcgttcaagacccaggtcgcctcggtcaaccgctacccggcgggcaactccgtcggttatgaccgcaccttcaccctcaagcgcgatgccctgctcgccaacctgcccctgggttactccgacggctatcgccgcgcgctgagcaacaaggcctatgtgctgatccagggccagaaggcgcccgtggtgggcaagacctccatgaacaccgtcatggtggacgtgaccgacatcaagggggtcaaacccggtgacgaggtggtactgttcggccgccagggggaagccgaggtgaggcagggggatctggaggagtacaacggcgccctgctggcggacatgtacaccgtctggggcaac

SEQ ID NO: 124 - protein, 361 aa, Unknown
  Obtained from environmental sample
  DOMAIN (2)...(233): Alanine racemase, N-terminal domain
  DOMAIN (240)...(357): Alanine racemase, C-terminal domain
  SITE (32)...(42): Alanine racemase pyridoxal-phosphate attachment site. Prosite id = PS00395
SNAWVEIDLGAFEHNLQTLKTRLGDKGPQICAIMKADAYGHGIDLLVPSVVKAGIPCIGIASNEEARVAREKGFEGRLMRVRAATPDEVEQALPYRLEELVGSLVSAQGISDIALRHNTRIPVHIGLNSAGMSRNGIDLRAEDAKGEALSMLALKGITPVGIMTHFPVEEKEDVKLGLAQFKLDTQWLIEAGKLDRSKLTIHAANSFATLELPEAYFDMVRPGGIIYGDTIPSYTEYKKVMAFKTQVASVNRYPAGNSVGYDRTFTLKRDALLANLPLGYSDGYRRALSNKAYVLIQGQKAPVVGKTSMNTVMVDVTDIKGVKPGDEVVLFGRQGEAEVRQGDLEEYNGALLADMYTVWGN

SEQ ID NO: 125 - DNA, 1083 bp, Unknown
  Obtained from environmental sample
agcaacgcctgggttgaggtcaacaaggccgcattcgagcacaacattcgcaccctgcaagccgagctggacggcaagtcgaagctttgcgcagtgctcaaggccgacgcctacggtcacggcattggcttgctgatgccctcggtgattgcgctgggcgtgccctgcgtggcgatcgccagcaacgaagaggcgcgcgtggtgcgcgagagtggcttcaagggtcagttgatccgggtccgtcagggggctttgagcgagatcgacaatgccttgcagtacaacgtcgaagagctggtgggcaacctcgacctcgctcgccaagcagctgaggtggcgcagaagcaggggcgcaagttgcaggtgcacatcgccctcaactccagtggcatgagccgtaacggcctggaaatgaacagcgaacagggcaagcaggacgccctggcgatcacccagctgccgaacgtcgaagtgctggcgataatgacccactacgcagtggaagagcgcgaggacgtgctcaagggcttggccgcgttcaaggaacagtccgcctggctgatggacaaggcgcagctcgaccgcagcaagatcactctgcacaccgccaactccttcgccaccctggaagtgcccgaggcgcggttggacatggtgcgtaccggcggcgcgctgtttggcgacactgtcatcgagcgcaccgaatacaagaaggtcatgcagttcaagtcgcacgtggcctcggtcaacagctacccggccggcaacaccgtcggttacgaccgcacctacaccctggcgcgggattcgaagctggccaacatcaccgtcggctactccgatggctaccgccgggtgttcaccaataagggcatcgtgctgatcaatggtcaccgcgtgccggtggtcggcaaggtctcgatgaataccttgatggtcgatgtcaccgacgtcccgagcgtgcgcccaggcgatgaggtggtgctgttcggcaagcagggcgcggtggaaaccagccagacggaaatggaggaggccaacggtgcgctgctggccgacctgtacacggtctggggcagctcc

SEQ ID NO: 126 - protein, 361 aa, Unknown
  Obtained from environmental sample
  DOMAIN (2)...(231): Alanine racemase, N-terminal domain
  DOMAIN (239)...(356): Alanine racemase, C-terminal domain
  SITE (31)...(41): Alanine racemase pyridoxal-phosphate attachment site. Prosite id = PS00395
  SITE (128)...(131): N-glycosylation site. Prosite id = PS00001
  SITE (278)...(281): N-glycosylation site. Prosite id = PS00001
SNAWVEVNKAAFEHNIRTLQAELDGKSKLCAVLKADAYGHGIGLLMPSVIALGVPCVAIASNEEARVVRESGFKGQLIRVRQGALSEIDNALQYNVEELVGNLDLARQAAEVAQKQGRKLQVHIALNSSGMSRNGLEMNSEQGKQDALAITQLPNVEVLAIMTHYAVEEREDVLKGLAAFKEQSAWLMDKAQLDRSKITLHTANSFATLEVPEARLDMVRTGGALFGDTVIERTEYKKVMQFKSHVASVNSYPAGNTVGYDRTYTLARDSKLANITVGYSDGYRRVFTNKGIVLINGHRVPVVGKVSMNTLMVDVTDVPSVRPGDEVVLFGKQGAVETSQTEMEEANGALLADLYTVWGSS

SEQ ID NO: 127 - DNA, 258 bp, Unknown
  Obtained from environmental sample
atgtcgcatgccccgaccattctggtttttgattcagggctcggtggccttaccgtatttcgcgagacaaaagccgtgcgcccagacgcgcatttcgtctatctggccgatgacgcaggatttccgtacggagatctgagcgaggaagacctggtggctcgcgtcaccgaggtcctcgccgacgccattgcgcgacatgagcccgacctggtggttgtggcctgcaatacggcgtctacacttgcgctcgctcaattc

SEQ ID NO: 128 - protein, 86 aa, Unknown
  Obtained from environmental sample
  SITE (73)...(81): Aspartate and glutamate racemases signature 1. Prosite id = PS00923
MSHAPTILVFDSGLGGLTVFRETKAVRPDAHFVYLADDAGFPYGDLSEEDLVARVTEVLADAIARHEPDLVVVACNTASTLALAQF

SEQ ID NO: 129 - DNA, 957 bp, Unknown
  Obtained from environmental sample
ttgaacgacgttggtcccggcattcgggtagtggattcccataccgaaggggagcccactcgtgtcgtgtggagtggaggaccggatcttggtaaaggttcgttgcgcgaacgattgcaaagactccgggagaccgctgatgattttcggcgaactgtaatcctcgaacctcgcggatccgaggcgttggtgggagcgttgctgtgcgaaccggtggacgcaacttgtgcggcgggcgtcatctacttcaacaatgcgggctacctcggcatgtgcggtcacggaacgattggcgttgccgtcacactcgcatatttgggcaagattggaatcggaacccatcgcctggagacaccggttggagttgtcgaggtgaagctgctttcggcaaatgaagtctgcatcgaaaacgtgccgagctatcgctatcgctcaaaggtggctgtcgaggtggcgtctctcggcacagtggttggcgacattgcctggggcgggaattggttctttctcgtcgaaaagtcgccgtttgaattgaccgccgaaaatatccgcccgctcaacgatgcctgccatgaagtgcggatggctttgcgtcatcagcagatcaccggagctgacggtgccgagatcgatcatgtcgaattcttcggtccggctcagtccgacggcggtcatagccggaactttgtatattgccccggcggagcgttcgatcgctctccgtgtggaaccggaaccagcgcgaagatcgcctgtctggcggcggacggcaaactcaagccgggtgatcgttggattcaagagagcatcatcggtagcagattcacggcttcgtaccgcgaggactctgaggggcgaatcatcccatcggtttcagggcgcgcgtacatttgcgcggagtcgactctggttcaacaatcggatgatccctttcgcaacggtattgctattggataa

SEQ ID NO: 130 - protein, 318 aa, Unknown
  Obtained from environmental sample
  DOMAIN (10)...(316): Proline racemase
MNDVGPGIRVVDSHTEGEPTRVVWSGGPDLGKGSLRERLQRLRETADDFRRTVILEPRGSEALVGALLCEPVDATCAAGVIYFNNAGYLGMCGHGTIGVAVTLAYLGKIGIGTHRLETPVGVVEVKLLSANEVCIENVPSYRYRSKVAVEVASLGTVVGDIAWGGNWFFLVEKSPFELTAENIRPLNDACHEVRMALRHQQITGADGAEIDHVEFFGPAQSDGGHSRNFVYCPGGAFDRSPCGTGTSAKIACLAADGKLKPGDRWIQESIIGSRFTASYREDSEGRIIPSVSGRAYICAESTLVQQSDDPFRNGIAIG

SEQ ID NO: 131 - DNA, 1074 bp, Unknown
  Obtained from environmental sample
gtggcgcgggtggtcttgcggtgggcgcgctcggcgtacatccgcatcaccaccggatcgcacgcgctgttcgccgatgcgacgctcgccgacgtcgaacgcgctggcgcgaacgcaggcccgcaactcgccgacacgcaacccgacgacgtcgccgcgatcctgttcaccagcggctccaccggcgtgccgaagggcgtggtgtatcgccatcggcatttcgccgcgcagatcgacatgttgcgcgatgcgttcgggctcgcgcccggtggcgtcgacttgccgacgttcccgccgttcgcgctgttcgatccggcgctgggcgtgacctcgatcattcccgacatggatccctacgacaaggcctgccacttcgggctgattttcttcaacaacgtcggctacctcggcatgtgcgggcacggcctgatcggcgccatcgtggcgctggcccacgccgggctggtgaagccgggcctggtgcgcatcgacacgccggccggttacatcgcggccgtgctcggcgccaacggcgaggtcaccttcgacaacgtgccgagctaccgcaaacagcaggagatcgagctctacctgcctggcatcggcaacgtgccctgcgacatcgcctggggcggcaactggttttgcctaatcgagcagcacgagcagaaactcgagctggcgaacgtggccaagctcaccgactactgcctgcgcgtgcgccaggcggtcgccgacaccggtttccccgaggtggaccacgtcgagctgttcgggccgtcgcccacgccgggcgtgaacagccggagcttcgtgctctgcccgggcggcgcctatgaccgctcgccgtgcggcacgggcaccagtgcgaagctggcctgcctcgcggccgacaacaaactggctcccggcgccgagtgggtgcaggagagcatcgtcggcagcaccttccgcgcgaaataccgtcggcagggcgacaagatcgtcccgaccatcgccggcacggcccacgtgacctcggaggcgacgctgctgatcgatccggccgatccattcgcatgggggattcgatga

SEQ ID NO: 132 - protein, 357 aa, Unknown
  Obtained from environmental sample
  DOMAIN (55)...(357): Proline racemase
  SITE (54)...(65): Putative AMP-binding domain signature. Prosite id = PS00455
MARVVLRWARSAYIRITTGSHALFADATLADVERAGANAGPQLADTQPDDVAAILFTSGSTGVPKGVVYRHRHFAAQIDMLRDAFGLAPGGVDLPTFPPFALFDPALGVTSIIPDMDPYDKACHFGLIFFNNVGYLGMCGHGLIGAIVALAHAGLVKPGLVRIDTPAGYIAAVLGANGEVTFDNVPSYRKQQEIELYLPGIGNVPCDIAWGGNWFCLIEQHEQKLELANVAKLTDYCLRVRQAVADTGFPEVDHVELFGPSPTPGVNSRSFVLCPGGAYDRSPCGTGTSAKLACLAADNKLAPGAEWVQESIVGSTFRAKYRRQGDKIVPTIAGTAHVTSEATLLIDPADPFAWGIR

SEQ ID NO: 133 - DNA, 1227 bp, Unknown
  Obtained from environmental sample
atgcacaagaagacactgcttgccacgctgatcctgggcctgctggccggtcaggccgtcgcggccccttacctgccgctggccagcgatcatcgcaacggcgaagtgcagaccgccagcaatgcctggctggaagtcgatctcggcgccttcgagcacaacatccagaccctcaaggatcgcctcggtgacaaagggccgaagatctgcgccatcatgaaggccgacgcctacggccacggcatcgatctgctggtgccctcggtggtcaaggccggcatcccctgcatcggcatcgccagcaatgaagaggcccgcgtggcccgtgagaaaggcttcaccggccgcctgatgcgggtacgtgccgccaccccggccgaagtggaacaggccctgccctacaagatggaggagctcatcggcagcctggtgagtgcccagggcatcgccgacatcgcccagcgccactacaccaatatcccggtgcacatcgcactcaactccgccggcatgagccgcaacggcatcgatctgcgcctggctgactccaaggaagacgcgctggccatgctcaagctcaaggggatcaccccggtcggcatcatgacccacttcccggtggaggagaaagaggacgtcaagatggggctggcccagttcaaactggactcccagtggctgctggaagcgggcaagctggatcgcagcaagatcaccatccacgccgccaactccttcgccaccctggaagtgccggacgcctacttcgacatggtgcgcccgggcggcctgctgtacggtgactccatcccctcctacaccgagtacaagcgggtaatggcgttcaagacccaggttgcctccgtcaaccactacccggccggcaacaccgtcggttatgaccgcaccctcaccctcaagcgcgactcctggctcgccaacctgccgctgggctactccgacggctatcgccgggcgctgagcaacaaggcctatgtgctgatccagggccagaaggtgccggtggtgggcaagacctccatgaacaccatcatggtggacgtgaccgacctcaaaggggtcaaacccggtgacgaggtggtgctgttcggccgccagggtgaggccgaggtgagacaggcggatctcgaggagtacaacggcgccctgctggcggacatgtacaccatctggggctacaccaaccccaagaagatcaaccgctga

SEQ ID NO: 134 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKGPKICAIMKADAYGHGIDLLVPSVVKAGIPCIGIASNEEARVAREKGFTGRLMRVRAATPAEVEQALPYKMEELIGSLVSAQGIADIAQRHYTNIPVHIALNSAGMSRNGIDLRLADSKEDALAMLKLKGITPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNTVGYDRTLTLKRDSWLANLPLGYSDGYRRALSNKAYVLIQGQKVPVVGKTSMNTIMVDVTDLKGVKPGDEVVLFGRQGEAEVRQADLEEYNGALLADMYTIWGYTNPKKINR

SEQ ID NO: 135 - DNA, 1227 bp, Unknown
  Obtained from environmental sample
atgcacaagaagacactgctagctaccctgatcttcggcctgctcgcgggccaagccgttgcggctccctatctgccccttgtgacggatcatcgcagcggccaggagcaaaccgccaacaacgcctggttggaagtggatctggacgcctttgagcacaatatccagaccctcaaggatcgcctcggcgacaagggcccgcagatctgcgccatcatgaaggccgacgcttacggtcatggcatcgacctgctggtcccctccgtggtcaaggccaatatcccctgcatcggcatcgccagcaacgaagaggcgcgcgtcgcccgcgagaagggctttaccggccgtctgatgcgggtgcgtgctgccaccccggatgaagtagagcaggccctgccctacaagatggaggagctgatcggcagtctggtgagtgcccagggtatcgccgatatcgcccagcgccaccacaccaccattccggtgcatatcgcgctcaactccgccggcatgagccgcaacggcatcgacctgcgtctggccgatgccaagcaggatgcgctggccatgctcaagctaaaggggatcaccccggtcggcatcatgacccacttcccggttgaggagaaagaggacgtcaagatggggctggcccagttcaaactggactcccagtggctgctggaagcgggcaaactggatcgcagcaagatcaccatccacgccgccaactccttcgccactctggccgtgccggacgcctacttcgacatggtgcgcccgggcggcctgctctacggtgactccatcccctcccacaccgagtacaagcgggtgatggcattcaagacccaggtcgcctcggtcaaccactatgccgcgggcaacaccgtcggttatgaccgcacctttaccctcaagcgtgactcctggctcgccaacctgccgctgggctactccgatggctatcgccgcgccctcagcaacaaagcctatgtgctgatcaagggtcagaaggtgccggtggtcggcaaaacttccatgaacaccatcatggtggatgtgactgatctgaaaggggtgaaacccggtgacgaggtggtgctgtttggccgtcagggtgaaaccgaagtgaaacaggcggatctggaggagtacagcggcgccctgctggcggacatgtacaccatctggggctacaccaaccccaagaagatcaaacgctaa

SEQ ID NO: 136 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLIFGLLAGQAVAAPYLPLVTDHRSGQEQTANNAWLEVDLDAFEHNIQTLKDRLGDKGPQICAIMKADAYGHGIDLLVPSVVKANIPCIGIASNEEARVAREKGFTGRLMRVRAATPDEVEQALPYKMEELIGSLVSAQGIADIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHYAAGNTVGYDRTFTLKRDSWLANLPLGYSDGYRRALSNKAYVLIKGQKVPVVGKTSMNTIMVDVTDLKGVKPGDEVVLFGRQGETEVKQADLEEYSGALLADMYTIWGYTNPKKIKR

SEQ ID NO: 137 - DNA, 1218 bp, Unknown
  Obtained from environmental sample
atgcacaagaagacactgctagctaccctgatcttcggcctgctcgcgggccaagccgttgcggctccctatctgccccttgtgacggatcattgcagcggccaggagcaaaccgccagcaacgcctggttggaagtggatctgggcgcctttgagcacaatatccagaccctcaaggatcgcctcggcgacaagggcccgcagatctgcgccatcatgaaggccgacgcttacggtcatggcatcgacctgctggtcccctccgtggtcaaggccaatatcccctgcatcggcatcgccagcaacgaagaggcgcgcgtcgcccgcgagaagggctttaccggccgtctgatgcgggtgcgtgctgccaccccggatgaagtagagcaggccctgccctacaagatggaggagctgatcggcagtctggtgagtgcccagggtatcgccgatatcgcccagcgccaccacaccaccattccggtgcatatcgcgctcaactccgccggcatgagccgcaacggcatcgacctgcgtctggccgatgccaagcaggatgcgctggccatgctcaagctaaaggggatcaccccggtcggcatcatgacccactccccggttgaggagaaagaggacgtcaagatggggctggcccagttcaagctggactcccagtggctgctggaagcgggcaaactggatcgcagcaagatcaccatccacgccgccaactccttcgccgctctggccgtgccggacgcctacttcgacatggtgcgcccgggcggcctgctctacggtgactccatcccctcccacaccgagtacaagcgggtgatggcattcaagacccaggtcgcctcggtcaaccactatgccgcgggcaacaccgtcggttatgaccgcacctttaccctcaagcgtgactcctggctcgccaacctgccgctgggctactccgatggctatcgccgcgccctcagcaacaaagcctatgtgctgatcaagggtcagaaggtgccggtggtcggcaagacttccatgaacaccatcatggtggatgtgactgatctgaaaggggtgaaacccggtgacgaggtggtgctgtttggccgtcagggtgaaaccgaagtgaaacaggcggatctggaggagtacaacggcgccctgctggcggacatgtacaccatctggggctacaccaaccccaagaagatc

SEQ ID NO: 138 - protein, 406 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLIFGLLAGQAVAAPYLPLVTDHCSGQEQTASNAWLEVDLGAFEHNIQTLKDRLGDKGPQICAIMKADAYGHGIDLLVPSVVKANIPCIGIASNEEARVAREKGFTGRLMRVRAATPDEVEQALPYKMEELIGSLVSAQGIADIAQRHHTTIPVHIALNSAGMSRNGIDLRLADAKQDALAMLKLKGITPVGIMTHSPVEEKEDVKMGLAQFKLDSQWLLEAGKLDRSKITIHAANSFAALAVPDAYFDMVRPGGLLYGDSIPSHTEYKRVMAFKTQVASVNHYAAGNTVGYDRTFTLKRDSWLANLPLGYSDGYRRALSNKAYVLIKGQKVPVVGKTSMNTIMVDVTDLKGVKPGDEVVLFGRQGETEVKQADLEEYNGALLADMYTIWGYTNPKKI

SEQ ID NO: 139 - DNA, 1221 bp, Unknown
  Obtained from environmental sample
atgcacaagaagacactgcttgccacgctgatcctgggcctgctggccggtcaggccgtcgcggccccttacctgccgctggccagcgatcatcgcaacggcgaagtgcagaccgccagcaatgcctggctggaagtcgatctcggcgccttcgagcacaacatccagaccctcaaggatcgcctcggtgacaaagggccgaagatctgcgccatcatgaaggccgacgcctacggccacggcatcgatctgctggtgccctcggtggtcaaggccggcatcccctgcatcggcatcgccagcaatgaagaggcccgcgtggcccgtgagaaaggcttcaccggccgcctgatgcgggtacgtgccgccaccccggccgaagtggaacaggccctgccctacaagatggaggagctcatcggcagcctggtgagtgcccagggcatcgccgacatcgcccagcgccaccacaccaatatcccggtgcacatcgcactcaactccgccggcatgagccgcaacggcatcgatctgcgcctggctgactccaaggaagacgcgctggccatgctcaagctcaaggggatcaccccggtcggcatcatgacccacttcccggtggaggagaaagaggacgtcaagatggggctggcccagttcaaactggactcccagtggctgctggaagcgggcaagctggatcgcagcaagatcaccatccacgccgccaactccttcgccaccctggaagtgccggacgcctacttcgacatggtgcgcccgggcggcctgctgtacggtgactccatcccctcctacaccgagtacaagcgggtaatggcgttcaagacccaggttgcctccgtcaaccactacccggccggcaacaccgtcggttatgaccgcaccttcaccctcaagcgcgactcctggctcgccaacctgccgctgggctactccgacggctatcgccgggcgctgagcaacaaggcctatgtgctgatccagggccagaaggtgccggtggtgggcaagacctccatgaacaccatcatggtggacgtgaccgacctcaaaggggtcaaacccggtgacgaggtggtgctgttcggccgccagggtgaggccgaggtgaaacaggcggatctcgaggagtacaacggcgccctgctggcggacatgtacaccatctggggctacaccaaccccaagaagatcaat

SEQ ID NO: 140 - protein, 407 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKGPKICAIMKADAYGHGIDLLVPSVVKAGIPCIGIASNEEARVAREKGFTGRLMRVRAATPAEVEQALPYKMEELIGSLVSAQGIADIAQRHHTNIPVHIALNSAGMSRNGIDLRLADSKEDALAMLKLKGITPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIN

SEQ ID NO: 141 - DNA, 1227 bp, Unknown
  Obtained from environmental sample
atgcacaagaagacactgctggcgaccctgatttttggcctgctggccggccaggcggtcgccgccccctatctgccgctcgccgacgaccaccgcaacggtcaggaacagaccgccgccaacgcctggctggaagtggatctcggtgccttcgagcacaacatccagaccctgaagaatcgcctcggtgacaagggcccgcagatctgcgccatcatgaaggcggacgcctacggtcacggcatcgacctgctggtcccttccgtggtcaaggcaggcatcccctgcatcggcatcgccagcaacgaagaagcacgtgttgcccgcgagaagggcttcgaaggtcgcctgatgcgggtgcgtgccgccaccccggatgaagtggagcaagccctgccctacgagctggaagagctcatcggcagcctggagagcgccaaggggatcgccgacatcgcccagcgccatgacaccaacatcccggtgcacattggcctgaactccgccggcatgagccgcaacggcatcgatctgcgccaggacgatgccaaggccgatgccctggccatgctcaagctcaaggggatcaccccggtcggcatcatgacccacttcccggtggaggagaaagaggacgtcaagctggggctggcccagttcaagctggactaccagtggctcatcgacgccggcaagctggatcgcagcaagctcaccatccacgccgccaactccttcgccaccctggaagtgccggaagcctactttgacatggtgcgcccgggcggcatcatctatggcgacaccattccctcctacaccgagtacaagaaggtgatggcgttcaagacccaggtcgcctccgtcaaccactacccggcgggcaacaccgtcggctatgaccgcaccttcaccctcaagcgcgactccctgctggccaacctgccgatgggctactccgacggctaccgccgcgccatgagcaacaaggcctatgtgctgatccatggccagaaggcccccgtcgtgggcaagacttccatgaacaccaccatggtggacgtcaccgacatcaaggggatcaaacccggtgacgaggtggtcctgttcggacgccagggtgatgccgaagtgaaacaatctgatctggaggagtacaacggtgccctcttggcggacatgtacaccgtctggggctacaccaaccccaagaagatcaaccgctaa

SEQ ID NO: 142 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
  SITE (354)...(357): N-glycosylation site. Prosite id = PS00001
MHKKTLLATLIFGLLAGQAVAAPYLPLADDHRNGQEQTAANAWLEVDLGAFEHNIQTLKNRLGDKGPQICAIMKADAYGHGIDLLVPSVVKAGIPCIGIASNEEARVAREKGFEGRLMRVRAATPDEVEQALPYELEELIGSLESAKGIADIAQRHDTNIPVHIGLNSAGMSRNGIDLRQDDAKADALAMLKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPMGYSDGYRRAMSNKAYVLIHGQKAPVVGKTSMNTTMVDVTDIKGIKPGDEVVLFGRQGDAEVKQSDLEEYNGALLADMYTVWGYTNPKKINR

SEQ ID NO: 143 - DNA, 1227 bp, Unknown
  Obtained from environmental sample
atgcacaagaagacactgctagccacgctgatcctgggcctgctggccggtcaggccgtcgcggccccttacctgccgctggccagcgatcatcgcaacggcgaagtgcagaccgccagcaatgcctggctggaagtcgatctcggcgccttcgagcacaacatccagaccctcaaggatcgcctcggtgacaaagggccgaagatctgcgccatcatgaaggccgacgcctacggccacggcatcgatctgctggtgccctcggtggtcaaggccggcatcccctgcatcggcatcgccagcaatgaagaggcccgcgtggcccgtgagaaaggcttcaccggccgcctgatgcgggtacgtgccgccaccccggccgaagtggaacaggccctgccctacaagatggaggagctcatcggcagcctggtgagtgcccagggcatcgccgacatcgcccagcgccaccacaccaatatcccggtgcacatcgcactcaactccgccggcatgagccgcaacggcatcgatctgcgcctggctgactccaaggaagacgcgctggccatgctcaagctcaaggggatcaccccggtcggcatcatgacccacttcccggtggaggagaaagaggacgtcaagatggggctggcccagttcaaactggactcccagtggctgctggaagcgggcaagctggatcgcagcaagatcaccatccacgccgccaactccttcgccaccctggaagtgccggacgcctacttcgacatggtgcgcccgggcggcctgctgtacggtgactccatcccctcctacaccgagtacaagcgggtaatggcgttcaagacccaggttgcctccgtcaaccactacccggccggcaacaccgtcggttatgaccgcaccttcaccctcaagcgcgactcctggctcgccaacctgccgctgggctactccgacggctatcgccgggcgctgagcaacaaggcctatgtgctgatccagggccagaaggtgccggtggtgggcaagacctccatgaacaccatcatggtggacgtgaccgacctcaaaggggtcaaacccggtgacgaggtggtgctgttcggccgccagggtgaggccgaggtgaaacaggcggatctcgaggagtacaacggcgccctgctggcggacatgtacaccatctggggctacaccaaccccaagaagatcaagcgctaa

SEQ ID NO: 144 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKGPKICAIMKADAYGHGIDLLVPSVVKAGIPCIGIASNEEARVAREKGFTGRLMRVRAATPAEVEQALPYKMEELIGSLVSAQGIADIAQRHHTNIPVHIALNSAGMSRNGIDLRLADSKEDALAMLKLKGITPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 145 - DNA, 1221 bp, Unknown
  Obtained from environmental sample
atgcacaagaagacactgcttgccaccctgatcctgggcctgctggccggtcaggccgtcgcggccccttacctgccgctggccagcgatcatcgcaacggcgaagtgcagaccgccagcaatgcctggctggaagtcgatctcggcgccttcgagcacaacatccagaccctcaaggatcgcctcggtgacaaagggccgaagatctgcgccatcatgaaggccgacgcctacggccacggcatcgacctgctggtcccctcggtggtcaaggccggtaccccctgcatcggcatcgccagcaacgaagaggcccgcgtggcccgcgagaagggcttcaccggccgcctaatgcgggtgcgtgccgccaccccggccgaagtggagcaggccctgccctacaagatggaagaactcatcggcagcctggtgagtgcccagggcatcgccgacatcgcccagcgccaccacaccaatatcccggtgcacatcgcgctcaactccgccggcatgagccgcaacggcatcgatctgcgtctggctgactccaaggaagacgcgctggccatgctcaagctcaaggggatcaccccggtcggcatcatgacccacttcccggtggaggagaaagaggacgtcaagatggggctggcccagttcaagctggactcccagtggctgctggaagcgggcaagctggatcgcagcaagatcaccatccacgccgccaactccttcgccaccctggaagtgccggacgcctacttcgacatggtgcgcccgggtggcctgctgtacggcgactccatcccctcctacaccgagtacaagcgggtgatggcgttcaagacccaggttgcctccgtcaaccactacccggccggcaacaccgtcggttatgaccgcaccttcaccctcaagcgcgactcctggctcgccaacctgccgctgggctactccgacggctatcgccgggcgctgagcaacaaggcctatgtgctgatccagggccagaaggtgccggtggtgggcaagacctccatgaacaccatcatggtggacgtgaccgatctcaagggagtcaaacccggtgacgaggtggtgctgttcggccgccagggtgaagccgaggtgaaacaggcggatctcgaggagtacaacggcgccctgctggcggacatgtacaccatctggggctacaccaaccccaagaagatcaac

SEQ ID NO: 146 - protein, 407 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKGPKICAIMKADAYGHGIDLLVPSVVKAGTPCIGIASNEEARVAREKGFTGRLMRVRAATPAEVEQALPYKMEELIGSLVSAQGIADIAQRHHTNIPVHIALNSAGMSRNGIDLRLADSKEDALAMLKLKGITPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIN

SEQ ID NO: 147 - DNA, 1221 bp, Unknown
  Obtained from environmental sample
atgcacaagaagacactgctagccaccttgatcctgggcctgctggccggtcaggccgtcgccgcgccctacctgccgctggcaagcgatcatcgcaatggcgaggtacaaaccgccagcaatgcctggctggaagttgatctcggcgccttcgagcacaacatccagaccctcaaggatcgcctcggtgacaaggacccgcagatctgcgccatcatgaaggcggacgcctacggccacggcatcgacctgctggtgccctcggtagtcaaggccaacatcccctgcatcggcatcgccagcaacgaagaggcccgcgtggcccgcgagaagggctttaccggccgcctgatgcgggtgcgctctgccaccccggacgaagtggagcaggccctgccctacaagatggaagagctgatcggcagcctggtgagcgcccagggcatagccgacatcgcccagcgtcaccataccaatatcccggtgcacataggtctcaactccgccggcatgagccgcaacggcatagacctgcgtctggcggactccaaggccgatgcgctggccatgctcaagctcaaggggatcaccccggtcggcatcatgacccacttcccggtggaagagaaagaggacgtcaagctggggctggcccagttcaagctggactcccagtggctgatcgaggcgggcaagctggatcgcagcaagctcaccatccacgcggccaactccttcgccaccctggaagtgccggacgcctacttcgacatggtgcgcccgggcggcctgctgtacggcgactccatcccctcctacaccgaatacaagcgggtcatggcgttcaagacccaggtggcctcggtcaaccactacccggccggcaataccgtcggctatgaccgcaccttcaccctcaagcgcgactcctggctcgccaacctgccgctgggttactccgacggctaccgccgtgcgctcagcaacaaggcctatgtgctgatccagggtcagaaggtgcccgtggtcggcaagacctccatgaacaccatcatggtggacgtgaccgatctgaaaggggtgaaacccggcgacgaggtggtgctgtttggccgtcaaggtgaggccgaggtgaagcaggcggatctggaggagtacaacggcgccctgctggcggacatgtacaccatctggggctacaccaaccccaagaagatcaac

SEQ ID NO: 148 - protein, 407 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKDPQICAIMKADAYGHGIDLLVPSVVKANIPCIGIASNEEARVAREKGFTGRLMRVRSATPDEVEQALPYKMEELIGSLVSAQGIADIAQRHHTNIPVHIGLNSAGMSRNGIDLRLADSKADALAMLKLKGITPVGIMTHFPVEEKEDVKLGLAQFKLDSQWLIEAGKLDRSKLTIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIN

SEQ ID NO: 149 - DNA, 1227 bp, Unknown
  Obtained from environmental sample
atgcacaagaagacactgctcgccaccctcgtcttcggcctgctggccggccaggcggtcgccgccccctacctgccgctcgccagcgacacccgcaacggtcaggagcagaccgcagccaacgcctggctggaagtggatctgggcgccttcgagcacaacatccagaccctcaaggatcgcctcggcgacaagggcccgcagatctgcgccatcatgaaggcggacgcctacggtcacggcatcgacctgctggtgccttccgtggtcaaggccaacatcccctgcatcggcatagccagcaacgaagaggcccgcgtggcccgtgagaagggcttcgaaggccggctgatgcgggtccgtgccgccaccccgaccgaggtggagcaggccctgccctacaagctggaagagctcatcggcagcctggagagtgccaagggcatctccgacatcgccctgcgccacaacaccaaggtgccggtgcaccttggtctgaactccgccggcatgagccgcaacggcatcgacctgcgccaggccggcgccaaggaagagaccctggccatgctcaagctgccgggcatcaccccggtcggcatcatgacccacttcccggtggaggaaaaagaagacgtcaagctgggtctggcccagttcaagctggacagccagtggctgctggaagcgggcaagctggatcgcagcaagatcaccatccatgccgccaactccttcgccaccctggaagtgcctgacgcctacttcgacatggtgcgcccgggcggcctgctgtacggcgactccatcccctcctacaccgagtacaagcgcgtcatggcgttcaagacccaggttgcctcggtcaaccactacccggcgggcaataccgtcggctatgaccgcaccttcaccctcaagcgcgactccctgctggcgaacctgccgctgggttactccgacggctatcgccgtgcgctcagcaacaaggcctatgtgctgatccagggtcagaaggtgcctgtggtcggcaagacctccatgaacaccatcatggtggacgtgaccgacctgaagggggtgaaacccggtgacgaggtggtgctgttcggccgccagggcgaggccgaggtgaagcaggcggatctggaagagtacaacggcgccctgctggcggacatgtacaccatctggggctacaccaaccccaagaagatcaaacgctga

SEQ ID NO: 150 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLGAFEHNIQTLKDRLGDKGPQICAIMKADAYGHGIDLLVPSVVKANIPCIGIASNEEARVAREKGFEGRLMRVRAATPTEVEQALPYKLEELIGSLESAKGISDIALRHNTKVPVHLGLNSAGMSRNGIDLRQAGAKEETLAMLKLPGITPVGIMTHFPVEEKEDVKLGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 151 - DNA, 1227 bp, Unknown
  Obtained from environmental sample
atgcacaagaagacactgcttgccaccctcgtcttcggcctgctggccggccaggcggtcgccgccccctacctgccgctcgccagcgacacccgcaacggtcaggagcagaccgcagccaacgcctggctggaagtggatctgggcgccttcgagcacaacatccagaccctcaaggatcgcctcggtgacaagggcccgcagatctgcgccatcatgaaggcggacgcctacggtcacggcatcgatctgctggtgccttccgtggtcaaggccaacatcccctgcatcggcatagccagcaacgaagaggcccgcgtggcccgcgagaagggcttcgaaggccggctgatacgggtccgtgccgccaccccgaccgaggtggagcaggccctgccctacaagctggaagagctcatcggcagcctggagagtgccaagggcatctccgacatcgccctgcgccacaacaccaaggtgccggtgcaccttggtctgaactccgccggcatgagccgcaacggcatcgacctgcgccaggccggcgccaaggaagagaccctggccatgctcaagctgccgggcatcaccccggtcggcatcatgacccacttcccggtggaggaaaaagaagacgtcaagctgggtctggcccagttcaagctggacagccagtggccgctggaagcgggcaagctggatcgcagcaagatcaccatccatgccgccaactccttcgccaccctggaagtgcctgacgcctacttcgacatggtgcgcccgggcggcctgctgtacggcgactccatcccctcctacaccgaatacaagcgggtcatggcgttcaagacccaggtggcctcggtcaaccactacccggccggcaataccgtcggctatgaccgcaccttcaccctcaagcgcgactcctggctcgccaacctgccgctgggttactccgacggctaccgccgtgcgctcagcaacaaggcctatgtgctgatccagggtcagaaggtgcccgtggtcggcaagacctccatgaacaccatcatggtggacgtgaccgatctgaaaggggtgaaacccggcgacgaggtggtgctgtttggccgtcaaggtgaggccgaggtgaagcaggcggatctggaggagtacaacggcgccctgctggcggacatgtacaccatctggggctacaccaaccccaagaagatcaaccgctga

SEQ ID NO: 152 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLGAFEHNIQTLKDRLGDKGPQICAIMKADAYGHGIDLLVPSVVKANIPCIGIASNEEARVAREKGFEGRLIRVRAATPTEVEQALPYKLEELIGSLESAKGISDIALRHNTKVPVHLGLNSAGMSRNGIDLRQAGAKEETLAMLKLPGITPVGIMTHFPVEEKEDVKLGLAQFKLDSQWPLEAGKLDRSKITIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 153 - DNA, 1221 bp, Unknown
  Obtained from environmental sample
atgcacaagaagacactgcttgccaccttgatcctgggcctgctggccggtcaggccgtcgccgcgccctacctgccgctggcaagcgatcatcgcaatggcgaggtacaaaccgccagcaatgcctggctggaagttgatctcggcgccttcgagcacaacatccagaccctcaaggatcgcctcggtgacaagggcccgcagatctgcgccatcatgaaggcggacgcctacggccacggcatcgacctgctggtgccctccgtggtcaaggccaacatcccctgcatcggcatcgccagcaacgaagaggcccgcgtggcccgcgagaagggcttcaccggccgcctgatgcgggtgcgctctgccaccccgggcgaagtggagcaggccctgccctacaagatggaagagctgatcggcagcctggtgagcgcccagggcatagccgacatcgcccagcgtcaccataccaatatcccggtgcacataggtctcaactccgccggcatgagccgcaacggcatagacctgcgtctggcggactccaaggccgatgcgctggccatgctcaagctcaaggggatcaccccggtcggcatcatgacccacttcccggtggaagagaaagaggacgtcaagctggggctggcccagttcaagctggactcccagtggctgatcgaggcgggcaagctggatcgcagcaagctcaccatccacgcggccaactccttcgccaccctggaagtgccggacgcctacttcgacatggtgcgcccgggcggcctgctgtacggcgactccatcccctcctacaccgaatacaagcgggtcatggcgttcaagacccaggtggcctcggtcaaccactacccggccggcaataccgtcggctatgaccgcaccttcaccctcaagcgcgactcctggctcgccaacctgccgctgggttactccgacggctaccgccgtgcgctcagcaacaaggcctatgtgctgatccagggtcagaaggtgcccgtggtcggcaagacctccatgaacaccatcatggtggacgtgaccgatctgaaaggggtgaaacccggcgacgaggtggtgctgtttggccgtcaaggtgaggccgaggtgaagcaggcggatctggaggagtacaacggcgccctgctggcggacatgtacaccatctggggctacaccaaccccaagaagatcaac

SEQ ID NO: 154 - protein, 407 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKGPQICAIMKADAYGHGIDLLVPSVVKANIPCIGIASNEEARVAREKGFTGRLMRVRSATPGEVEQALPYKMEELIGSLVSAQGIADIAQRHHTNIPVHIGLNSAGMSRNGIDLRLADSKADALAMLKLKGITPVGIMTHFPVEEKEDVKLGLAQFKLDSQWLIEAGKLDRSKLTIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIN

SEQ ID NO: 155 - DNA, 1227 bp, Unknown
  Obtained from environmental sample
atgcacaagaagacactgctcgccacgctgatcctaggcctgctggccggtcaggccgttgcggccccttacctgccgctggccagcgatcatcgcaacggcgaagtgcagaccgccagcaatgcctggctggaagtcgatctcggcgccttcgagcacaacatccagaccctcaaggatcgcctcggtgacaaagggccgaagatctgcgccatcatgaaggccgacgcctacggccacggcatcgacctgctggtgccctcggtggtcaaggccggtatcccctgcatcggcatcgccagcaatgaagaggcccgcgtggcccgtgagaagggcttcaccggccgcctgatgcgggtgcgctctgccaccccggacgaagtggagcaggccctgccctacaagatggaagagctgatcggcagcctggtgagcgcccagggcatagccgacatcgcccagcgtcaccataccaatatcccggtgcacataggtctcaactccgccggcatgagccgcaacggcatagacctgcgtctggcggactccaaggccgatgcgctggccatgctcaagctcaaggggatcaccccggtcggcatcatgacccacttcccggtggaagagaaagaggacgtcaagctggggctggcccagttcaagctggactaccagtggctcatcgatgcgggcaagctggatcgcagcaagctcaccatccacgccgccaactccttcgccaccctggaagtgccggaagcctactttgacatggttcgcccgggcggcatcatctacggtgacaccatcccctcctacaccgaatacaagaaggtgatggcgttcaagacccaggtcgcctcggtaaaccactacccggcgggcaacaccgtcggctatgaccgcaccttcaccctcaagcgtgactccctgctcgccaacctgccgctgggttactccgacggctaccgccgtgcgctgagcaacaaggcctatgtgctgatccagggccagaaggtgcccgtggtgggcaagacctccatgaacaccatcatggtggacgtgaccgatctcaaaggggtcaaacccggtgacgaggtggtgctgttcggccaccagggtgaagccgaggtgaaacaggcggatctggaagagtacaacggcgccctgctggcggacatgtacaccatctggggctacaccaaccccaagaagatcaagcgctaa

SEQ ID NO: 156 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKGPKICAIMKADAYGHGIDLLVPSVVKAGIPCIGIASNEEARVAREKGFTGRLMRVRSATPDEVEQALPYKMEELIGSLVSAQGIADIAQRHHTNIPVHIGLNSAGMSRNGIDLRLADSKADALAMLKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGHQGEAEVKQADLEEYNGALLADMYTIWGYTNPKKIKR

SEQ ID NO: 157 - DNA, 1227 bp, Unknown
  Obtained from environmental sample
atgcacaagaagacactgcttgccaccctcgtcttcggcctgctggccggccaggcggtcgccgccccctacctgccgctcgccagcgacacccgcaacggtcaggagcagaccgccgccaacgcctggctggaagtggatctgggtgccttcgagcacaacatccagaccctcaaggatcgcctcggtgacaagggcccgcagatctgcgccatcatgaaggcggacgcctacggtcacggcatcgatctgctggtgccctcggtggtcaaggccaacatcccctgcatcggcatcgccagcaacgaagaggcccgggtggctcgggagaaaggcttcgaaggccgactgatgcgggtccgagccgccaccccgaccgaggtggaacaggccctgccctacaagctggaagagctcatcggcagcctggagagtgccaagggcatctccgacatcgccctgcgccacaacaccaaagtgccggtgcaccttggtctgaactccgccggcatgagccgcaacggcatcgacctgcgccaggccggcgccaaggacgaggccctggccatgctcaagctgccgggtatcaccccggtcggcatcatgacccacttcccggtggaggagaaagaggacgtcaagctgggtctggcccagttcaagctggacagccagtggctgctggaagccggcaagctggatcgcagcaagatcaccatccatgccgccaactccttcgccaccctggaagtgcctgacgcctacttcgacatggtgcgcccgggcggcctgctgtacggcgactccatcccctcctacaccgagtacaagcgcgtcatggcgttcaagacccaggtcgcctcggtcaaccactacccggccggcaacaccgtcggctatgaccgcacctttaccctcaagcgcgactccttgctggccaacctgccgctcggctactccgacggctatcgccgcgcgctcagcaacaaggcctatgtgttgatccagggtcagaaggtgcctgtggtcggcaagacctccatgaacaccatcatggtggacgtgactgatctgaagggagtgaaacccggtgacgaggtggtgctgttcggccgccagggcaaggccgaggtgaaacaggcggatctggaggagtacaacggcgccctgctggcggacatgtacaccatctggggctacaccaaccccaagaagatcaaccgctaa

SEQ ID NO: 158 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLGAFEHNIQTLKDRLGDKGPQICAIMKADAYGHGIDLLVPSVVKANIPCIGIASNEEARVAREKGFEGRLMRVRAATPTEVEQALPYKLEELIGSLESAKGISDIALRHNTKVPVHLGLNSAGMSRNGIDLRQAGAKDEALAMLKLPGITPVGIMTHFPVEEKEDVKLGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGKAEVKQADLEEYNGALLADMYTIWGYTNPKKINR

SEQ ID NO: 159 - DNA, 1227 bp, Unknown
  Obtained from environmental sample
atgcacaagaagacactgcttgccaccctcgtcttcggcctgctggccggccaggcggtcgccgccccctacctgccgctcgccagcgacacccgcaacggtcaggagcagaccgcagccaacgcctggctggaagtggatctgggcgccttcgagcacaacatccagaccctcaaggatcgcctcggtgacaagggcccgcagatctgcgccatcatgaaggcggacgcctacggtcacggcatcgatctgctggtgccttccgtggtcaaggccaacatcccctgcatcggcatagccagcaacgaagaggcccgcgtggcccgtgagaagggcttcgaaggccggctgatgcgggtccgtgccgccaccccgaccgaggtggagcaggccctgccctacaagctggaagagctcatcggcagcctggagagtgccaagggcatctccgacatcgccctgcgccacaacaccaaggtgccggtgcaccttggtctgaactccgccggcatgagccgcaacggcatcgacctgcgccaggccggcgccaaggaagagaccctggccatgctcaagctgccgggcatcaccccggtcggcatcatgacccacttcccggtggaggaaaaagaagacgtcaagctgggtctggcccagttcaagctggacagccagtggctgctggaagcgggcaagctggatcgcagcaagatcaccatccatgccgccaactccttcgccaccctggaagtgcctgacgcctacttcgacatggtgcgcccgggcggcctgctgtacggcgactccatcccctcctacaccgagtacaagcgcgtcatggcgttcaagacccaggttgcctcggtcaaccactacccggcgggcaataccgtcggctatgaccgcaccttcaccctcaagcgcgactccctgctggcgaacctgccgctgggttactccgacggctatcgccgtgcgctcagcaacaaggcctatgtgctgatccagggtcagaaggcgcctgtggtcggcaagacctccatgaacaccatcatggtggacgtgaccgacctgaagggggtgaaacccggtgacgaggtggtgctgttcggccgccagggcgaggccgaggtgaagcaggcggatctggaagagtacaacggcgccctgctggcggacatgtacaccatctggggctacaccaaccccaagaagatcaaccgctga

SEQ ID NO: 160 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLGAFEHNIQTLKDRLGDKGPQICAIMKADAYGHGIDLLVPSVVKANIPCIGIASNEEARVAREKGFEGRLMRVRAATPTEVEQALPYKLEELIGSLESAKGISDIALRHNTKVPVHLGLNSAGMSRNGIDLRQAGAKEETLAMLKLPGITPVGIMTHFPVEEKEDVKLGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSLLANLPLGYSDGYRRALSNKAYVLIQGQKAPVVGKTSMNTIMVDVTDLKGVKPGDEVVLFGRQGEAEVKQADLEEYNGALLADMYTIWGYTNPKKINR

SEQ ID NO: 161 - DNA, 1227 bp, Unknown
  Obtained from environmental sample
atgcacaagaagacactgctcgccaccttgatcctgggcctgctggccggtcaggccgtcgccgcgccctacctgccgctggcaagcgatcatcgcaatggcgaggtacaaaccgccagcaatgcctggctggaagttgatctcggcgccttcgagcacaacatccagaccctcaaggatcgcctcggtgacaagggcccgcagatctgcgccatcatgaaggcggacgcctacggccacggcatcgacctgctggtgccctccgtggtcaaggccaacatcccctgcatcggcatcgccagcaacgaagaggcccgcgtggcccgcgagaagggcttcaccggccgcctgatgcgggtgcgctctgccaccccggacgaagtggagcaggccctgccctacaagatggaagagctgatcggcagcctggtgagcgcccagggcatagccgacatcgcccagcgtcaccataccaatatcccggtgcacataggtctcagctccgccggcatgagccgcaacggcatagacctgcgtctggcggactccaaggccgatgcgctggccatgctcaagctcaaggggatcaccccggtcggcatcatgacccacttcccggtggaagagaaagaggacgtcaagctggggctggcccagttcaagctggactcccagtggctgatcgaggcgggcaagctggatcgcagcaagctcaccatccacgcggccaactccttcgccaccctggaagtgccggacgcctacttcgacatggtgcgcccgggcggcctgctgtacggcgactccatcccctcctacaccgaatacaagcgggtcatggcgttcaagacccaggtggcctcggtcaaccactacccggccggcaataccgtcggctatgaccgcaccttcaccctcaagcgcgactcctggctcgccaacctgccgctgggttactccgacggctaccgccgtgcgctcagcaacaaggcctatgtgctgatccagggtcagaaggtgcccgtggtcggcaagacctccatgaacaccatcatggtggacgtgaccgatctgaaaggggtgaaacccggcgacgaggtggtgctgtttggccgtcaaggtgaggccgaggtgaagcaggcggatctggaggagtacaacggcgccctgctggcggacatgtacaccatctggggctacaccaaccccaagaagatcaagcgctga

SEQ ID NO: 162 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKGPQICAIMKADAYGHGIDLLVPSVVKANIPCIGIASNEEARVAREKGFTGRLMRVRSATPDEVEQALPYKMEELIGSLVSAQGIADIAQRHHTNIPVHIGLSSAGMSRNGIDLRLADSKADALAMLKLKGITPVGIMTHFPVEEKEDVKLGLAQFKLDSQWLIEAGKLDRSKLTIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 163 - DNA, 1083 bp, Unknown
  Obtained from environmental sample
agcaatgcctgggtcgaggtcaacaaggccgccttcgaaaataatgtgcgcgccctgcaaaccacgctggatggaaaatccaagctctgcgccgtgttcaaggccgatgcctacggccacgggatcggcttgctgatgccctctgtgatcgccatgggcgtgccctgcatcggtgttgccagcaacgaagaagcccgcgtagtccgtgaaagcggcttcaagggccagttgatccgcgtgcgcaccgccgccttgagcgagctggaagccgcactgccctacaatatggaagaactggtgggcaacctcgacttcgccaaacaggccgccaatattgccgaaaaacacggccgcccactggtggtgcacctgggcctgaactctagcggcatgagccgcaacggtattgaaatggccaccgaacagggccgtcgtgatgcagtagccatcactcaagtgcctaacttgcaggtgcgggcgatcatgacccacttcgctgttgaagacgctgatgatgtacgcgccggtctcaaggccttcaacgaacaggcgcactggctgatgaaagaagccaaactggaccgcagcaaaatcaccctgcacgcggccaactcgttcgccaccctggaagtgcccgagtcgcatctggacatggtccgccccggcggcgcgctgttcggtgacaccgtgccgtcgcacagccaatacaagcgcgtgatgcagttcaagtcccatgtggcgtcggtcaacgactaccccaagggcaacacggtcggttatgaccgcaccttcaccctggaccgcgactccaaactggccaacatcaccgtgggctactctgacggttaccgccgcgccttcaccaacaaaggcatcgtgctgatcaacggccaccgcgtgccggtggtgggtaaagtgtcaatgaacaccctgatggtggacgtcaccgatgcgccggacgtgaaaagcggcgatgaagtggtgctgttcggccaacagggcaacgcccagatcagccaggccgaagtggaagacatcaacggcgcactgctggccgacctgtacaccgtatggggctgctcc

SEQ ID NO: 164 - protein, 361 aa, Unknown
  Obtained from environmental sample
  DOMAIN (2)...(231): Alanine racemase, N-terminal domain
  DOMAIN (239)...(356): Alanine racemase, C-terminal domain
  SITE (31)...(41): Alanine racemase pyridoxal-phosphate attachment site. Prosite id = PS00395
  SITE (128)...(131): N-glycosylation site. Prosite id = PS00001
  SITE (278)...(281): N-glycosylation site. Prosite id = PS00001
SNAWVEVNKAAFENNVRALQTTLDGKSKLCAVFKADAYGHGIGLLMPSVIAMGVPCIGVASNEEARVVRESGFKGQLIRVRTAALSELEAALPYNMEELVGNLDFAKQAANIAEKHGRPLVVHLGLNSSGMSRNGIEMATEQGRRDAVAITQVPNLQVRAIMTHFAVEDADDVRAGLKAFNEQAHWLMKEAKLDRSKITLHAANSFATLEVPESHLDMVRPGGALFGDTVPSHSQYKRVMQFKSHVASVNDYPKGNTVGYDRTFTLDRDSKLANITVGYSDGYRRAFTNKGIVLINGHRVPVVGKVSMNTLMVDVTDAPDVKSGDEVVLFGQQGNAQISQAEVEDINGALLADLYTVWGCS

SEQ ID NO: 165 - DNA, 1080 bp, Unknown
  Obtained from environmental sample
agcaatgcctgggtggaggtcaacaaaaccgcgtttgaacacaatattcaggtcctgaaaaacaccctcggcgataaatcgaaaatctgtgcggtgctcaaggccgatgcctacggccacggcattggtttgttgatgccttcgatcatcgccactggcgtaccttgcgtcggcgttgccagcaacgaagaagcccgcgtggtccgcgagagcggttacaaaggccaattggttcgcgtgcgcaccgccgcccttagcgagctggaagcggcgctgccgtacaacatggaagagttggtcggcaacctcgatttcgctaagaaagccgcgcaaattgccgaaaaacacggccgtccgctcgtcgtgcacctgggcttgaactccagcggcatgagccgtaacggcgtagaaatgagcaccgctcaaggccgcagcgatgccgtagccatcactataataccgaacctggaagtacgggcgatcatgacccacttcgccgtggaagacgccgatgacgtgcgcgcgggcctgaaggcgttcaacgaacaggcacagtggctgatcaaagaggccaagctggatcgcagcaaaatcaccctgcatgcggccaactcgttcgccaccctggaagtgcctgaatcgcacctggacatggtccgcccaggcggcgcgctgttcggtgacacggtgccttcgcacaccgactacaagcgcgtcatgcaattcaagtcgcacgtggcctcggtcaacagctacccgaaaggcaataccgtcggctacgaccgcacctacaccctggagcgtgattcgaagctggcgaacattacggtcggttactccgacggctatcgccgtgcgttcaccaataaaggcatcgtgctgatcaacggccaccgcgtgccggtggtgggcaaagtgtcgatgaacaccttgatggttgacgtgaccgatgcgccggacgtcaaaagcggcgatgaagtggtgctgttcggcaaacagggcgacgccgagatcagccagagcgaagttgaagacatcaacggtgcattgttggctgacctgtacaccgtctggggctgc

SEQ ID NO: 166 - protein, 360 aa, Unknown
  Obtained from environmental sample
  DOMAIN (2)...(231): Alanine racemase, N-terminal domain
  DOMAIN (239)...(356): Alanine racemase, C-terminal domain
  SITE (8)...(11): N-glycosylation site. Prosite id = PS00001
  SITE (31)...(41): Alanine racemase pyridoxal-phosphate attachment site. Prosite id = PS00395
  SITE (128)...(131): N-glycosylation site. Prosite id = PS00001
  SITE (278)...(281): N-glycosylation site. Prosite id = PS00001
SNAWVEVNKTAFEHNIQVLKNTLGDKSKICAVLKADAYGHGIGLLMPSIIATGVPCVGVASNEEARVVRESGYKGQLVRVRTAALSELEAALPYNMEELVGNLDFAKKAAQIAEKHGRPLVVHLGLNSSGMSRNGVEMSTAQGRSDAVAITIIPNLEVRAIMTHFAVEDADDVRAGLKAFNEQAQWLIKEAKLDRSKITLHAANSFATLEVPESHLDMVRPGGALFGDTVPSHTDYKRVMQFKSHVASVNSYPKGNTVGYDRTYTLERDSKLANITVGYSDGYRRAFTNKGIVLINGHRVPVVGKVSMNTLMVDVTDAPDVKSGDEVVLFGKQGDAEISQSEVEDINGALLADLYTVWGC

SEQ ID NO: 167 - DNA, 657 bp, Unknown
  Obtained from environmental sample
aaagaattcggcacgaggattgccgaatacgggatgaatgaacaccgggtcgactgggtcaaaattaccaatgttgcgagctacttggccgcctccgaaatagaagtagattttgcccctttggggcctttgcgtattgatgtcgcctacggcggaaatttctatgccattgtggagatacaagagcattttgaaggggttcaagcctataaagcagaagagttgatcagtatggccagagccctccgacggcagttgcgtgcggggtatccgactgaatttgttcatcccgaagattcgcgtatcaatggaatttctcatgtcctctggacagggaagcctcaacacccagattcgactgccagtaatgcggttttttacggcgataaagcgattgatcgttcgccttgcggtacaggcacctcagccagaatggcacagcgagctgcaaaaggattgctgcgacaaggagaaccttttttgcacgagagctatatcggttctgtatttgaaggaaacatagaaggtgaaactgtggtcggggattttccggcaatcgttccttccatcaaaggctgggcccgaatcttcggtcataatataattgaaattgacccggagaatgatccctatgcccacgggtttcaagtgatttaa

SEQ ID NO: 168 - protein, 218 aa, Unknown
  Obtained from environmental sample
  DOMAIN (1)...(216): Proline racemase
KEFGTRIAEYGMNEHRVDWVKITNVASYLAASEIEVDFAPLGPLRIDVAYGGNFYAIVEIQEHFEGVQAYKAEELISMARALRRQLRAGYPTEFVHPEDSRINGISHVLWTGKPQHPDSTASNAVFYGDKAIDRSPCGTGTSARMAQRAAKGLLRQGEPFLHESYIGSVFEGNIEGETVVGDFPAIVPSIKGWARIFGHNIIEIDPENDPYAHGFQVI

SEQ ID NO: 169 - DNA, 1227 bp, Unknown
  Obtained from environmental sample
atgcacaagaagacactgctagccaccttgatcctgggcctgctggccggtcaggccgtcgccgcgccctacctgccgctggcaaacgatcatcgcaatggcgacgtacaaaccgccagcaatgcctggctggaagtcgatctcggcgccttcgagcacaacatccaaaccctcaaggatcgcctcggtgacaagggcccgcagatctgcgccatcatgaaggctgacgcatatggtcacggcatcgacctgctggtcccctccgtggtcaaggccaatatcccctgcatcggcattgccagcaacgaagaggctcgcgtggcgcgcgagaagggcttcaccggccgcctgatgcgagtgcgttctgccactccggacgaagtggagcaggccctgccctacaagatggaagagctgatcggcagcctggtgagcgcccagggcatcgccgacatcgcccagcgtcaccataccaatatcccggtgcacatcggtctcaactccgccggcatgagccgcaacggcatcgacctgcgtctggcggactccaaggcagatgcgctggccatgctcaagctcaaggggatcaccccggtcggcatcatgacccacttcccggtggaagagaaagaggacgtcaagctgggactggcccagttcaagctggactcccagtggctgatcgaggcgggcaagctggatcgcagcaagctcaccatccacgcggccaactccttcgccaccctggaagtgccggacgcctacttcgacatggtgcgcccgggcggcctgctctacggtgactccatcccctcctacaccgaatacaagcgggtcatggcgttcaagacccaggtggcctcggtcaaccactacccggctggcaataccgtaggctatgaccgcaccttcactctcaaacgtgactcctggctcgccaacctgccgctgggatactccgacggctaccgccgtgcgctcagcaacaaggcctatgtgctgatccagggtcagaaagtgcctgtggtcggcaagacctccatgaacaccatcatggtggacgtgaccgacctgaaaggggtgaagcccggcgatgaagtggtgctgtttggccgtcagggtgaggccgaggtgaagcaggcggatctggaggagtacaacggtgccctgctggccgacatgtacactatctggggctacaccaaccccaagaagatcaagcgctaa

SEQ ID NO: 170 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPLANDHRNGDVQTASNAWLEVDLGAFEHNIQTLKDRLGDKGPQICAIMKADAYGHGIDLLVPSVVKANIPCIGIASNEEARVAREKGFTGRLMRVRSATPDEVEQALPYKMEELIGSLVSAQGIADIAQRHHTNIPVHIGLNSAGMSRNGIDLRLADSKADALAMLKLKGITPVGIMTHFPVEEKEDVKLGLAQFKLDSQWLIEAGKLDRSKLTIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 171 - DNA, 1227 bp, Unknown
  Obtained from environmental sample
atgcacaagaagacactgcttgccaccttgatcctgggcctgctggccggtcaagccgtcgcagccccctatctgccgctggcaagcgatcatcgcaatggcgatgtacaaaccgccagcaatgcctggctggaagtcgacctgaccgccttcgagcacaatatccagaccctcaaggatcgcctcggtgacaagggcccgcagatctgcgccatcatgaaggctgacgcatatggtcacggcatcgacctgctggccccctccgtggtcaaggccaatatcccctgcatcggcattgccagcaacgaagaggctcgcgtggcgcgcgagaagggcttcaccggccgcctgatgcgagtgcgttctgccactccggacgaagtggagcaggccctgccctacaagatggaagagctgatcggcagcctggtgagcgcccagggcatcgccgacatcgcccagcgtcaccataccaatatcccggtgcacatcggtctcaactccgccggcatgagccgcaacggcatcgacctgcgtctggcggactccaaggcagatgcgctggccatgctcaagctcaaggggatcaccccggtcggcatcatgacccacttcccggtggaagagaaagaggacgtcaagctgggactggcccagttcaagctggactcccagtggctgatcgaggcgggcaagctggatcgcagcaagctcaccatccacgcggccaactccttcgccaccctggaagtgccggacgcctacttcgacatggtgcgcccgggcggcctgctctacggtgactccatcccctcctacaccgaatacaagcgggtcatggcgttcaagacccaggtggcctcggtcaaccactacccggctggcaataccgtaggctatgaccgcaccttcactctcaaacgtgactcctggctcgccaacctgccgctgggatactccgacggctaccgccgtgcgctcagcaacaaggcctatgtgctgatccagggtcagaaagtgcctgtggtcggcaagacctccatgaacaccatcatggtagacgtgaccgacctgaaaggggtgaagcccggcgatgaagtggtgctgtttggccgtcagggtgaggccgaggtgaagcaggcggatctggaggagtacaacggtgccctgctggccgacatgtacactatctggggctacaccaaccccaagaagatcaaccgctga

SEQ ID NO: 172 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGDVQTASNAWLEVDLTAFEHNIQTLKDRLGDKGPQICAIMKADAYGHGIDLLAPSVVKANIPCIGIASNEEARVAREKGFTGRLMRVRSATPDEVEQALPYKMEELIGSLVSAQGIADIAQRHHTNIPVHIGLNSAGMSRNGIDLRLADSKADALAMLKLKGITPVGIMTHFPVEEKEDVKLGLAQFKLDSQWLIEAGKLDRSKLTIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 173 - DNA, 1221 bp, Unknown
  Obtained from environmental sample
atgcacaagaagacactgctggctaccctgatcttcggcctgctcgcgggccaagccgttgcggctccctatctgccccttgtgacggatcatcgcagcggccaggagcaaaccgccagcaacgcctggttggaagtggatctgggcgcctttgagcacaatatccagaccctcaaggatcgcctcggcgacaagggcccgcagatctgcgccatcatgaaggccgacgcttacggtcatggcatcgacctgctggtcccctccgtggtcaaggccaatatcccctgcatcggcatcgccagcaacgaagaggcgcgcgtcgcccgcgagaagggctttaccggccgtctgatgcgggtgcgtgctgccaccccggatgaagtagagcaggccctgccctacaagatggaggagctgatcggcagtctggtgagtgcccagggtatcgccgatatcgcccagcgccaccacaccaccattccggtgcatatcgcgctcaactccgccggcatgagccgcaacggcatcgacctgcgtctggccgatgccaagcaggatgcgctggccatgctcaagctaaaggggatcaccccggtcggcatcatgacccacttcccggttgaggagaaagaggacgtcaagatggggctggcccagttcaaactggactcccagtggctgctggaagcgggcaaactggatcgcagcaagatcaccatccacgccgccaactccttcgccactctggccgtgccggacgcctacttcgacatggtgcgcccgggcggcctgctctacggtgactccatcccctcccacaccgagtacaagcgggtgatggcattcaagacccaggtcgcctcggtcaaccactatgccgcgggcaacaccgtcggttatgaccgcacctttaccctcaagcgtgactcctggctcgccaacctgccgctgggctactccgatggctatcgccgcgccctcagcaacaaagcctatgtgctgatcaagggtcagaaggtgccggtggtcggcaagacttccatgaacaccatcatggtggatgtgactgatctgaaaggggtgaaacccggtgacgaggtggtgctgtttggccgtcagggtgaaaccgaagtgaaacaggcggatctggaggggtacaacggcgccctgctggcggacatgtacaccatctggggctacaccaaccccaagaagatcaaa

SEQ ID NO: 174 - protein, 407 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLIFGLLAGQAVAAPYLPLVTDHRSGQEQTASNAWLEVDLGAFEHNIQTLKDRLGDKGPQICAIMKADAYGHGIDLLVPSVVKANIPCIGIASNEEARVAREKGFTGRLMRVRAATPDEVEQALPYKMEELIGSLVSAQGIADIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHYAAGNTVGYDRTFTLKRDSWLANLPLGYSDGYRRALSNKAYVLIKGQKVPVVGKTSMNTIMVDVTDLKGVKPGDEVVLFGRQGETEVKQADLEGYNGALLADMYTIWGYTNPKKIK

SEQ ID NO: 175 - DNA, 1227 bp, Unknown
  Obtained from environmental sample
atgcacaagaagacactgctagcgaccctggtcttcgggttgctcgccggccaggccgtcgcagccccctatctgccgctggccagtgacacccgcaacggccaggagcagaccgccgccaacgcctggctggaagtggatttgaccgccttcgagcacaacatccagaccctcaaggatcgtctcggcgacaagggcccgcagatctgcgccatcatgaaggcggacgcctacggccacggcatcgatctgctggtgccctccgtggtcaaggcgggcattccctgcatcggcatcgccagcaatgaagaggcccgcgtggcccgcgagaagggcttcgagggccgcctgatgcgggtccgtgccgccaccccggttgaggtagagcaggcgctgccctacaagctggaagagctggtaggcagcctggagagcgccaaggggatcgctgacatcgcacagcgccataacaccaacgtgtcggtgcacatcggcctgaactccgccggcatgagccgtaacggcatcgacctgcgccagaatgacgccaaggccgatgccctggccatgctgaaactcaaggggatcaccccggtcggcatcatgacccacttcccggtggaggagaaagaggacgtcaagctggggctggcccagttcaagcttgactaccagtggctgatcgacgccggcaagctggatcgcagcaagctcaccatccacgccgccaactccttcgccaccctggaagtgccggaagcctactttgacatggtacgcccgggcggcatcatctacggtgacaccatcccctcctacaccgagtacaagaaggtgatggcgttcaagacccaggtcgcctccgtcaaccactacccggcgggcaacaccgtcggttatgaccgcaccttcaccctcaagcgcgactccctgctcgccaacctgccgatgggttactccgacggctaccgccgcgccatgagcaacaaggcctatgtgctgatccatggccagaaggcccctgtggtgggcaagacctccatgaacaccaccatggtggacgtgaccgacatcaaggggatcaaacccggtgacgaggtggtgctgttcggccgccagggggatgccgaggtgaagcagtctgacctggaagagtacaacggcgctctgctggcagacatgtacaccgtctggggctacaccaaccccaagaagatcaaccgctaa

SEQ ID NO: 176 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
  SITE (161)...(164): N-glycosylation site. Prosite id = PS00001
  SITE (354)...(357): N-glycosylation site. Prosite id = PS00001
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCIGIASNEEARVAREKGFEGRLMRVRAATPVEVEQALPYKLEELVGSLESAKGIADIAQRHNTNVSVHIGLNSAGMSRNGIDLRQNDAKADALAMLKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPMGYSDGYRRAMSNKAYVLIHGQKAPVVGKTSMNTTMVDVTDIKGIKPGDEVVLFGRQGDAEVKQSDLEEYNGALLADMYTVWGYTNPKKINR

SEQ ID NO: 177 - DNA, 1224 bp, Unknown
  Obtained from environmental sample
atgcacaagaagacactgcttgccacgctgatcctgggcctgctggccggtcaggccgtcgcggccccttacctgccgctggccagcgatcatcgcaacggcgaagtgcagaccgccagcaatgcctggctggaagtcgatctcggcgccttcgagcacaacatccagaccctcaaggatcgcctcggtggcaaagggccgaagatctgcgccatcatgaaggccgacgcctacggccacggcatcgacctgctggtgccctcggtggtcaaggccggcatcccctgcatcggcatcgccagcaacgaagaggcccgcgtggcccgtgagaagggcttcaccggccgcctgatgcgggtacgtgccgccaccccggccgaagtggaacaggccctgccctacaagatggaagagctcatcggcagcctggtgagtgctcagggcatcgccgacatcgcccagcgccaccacaccaatatcccggtgcacatcgcgctcaactccgccggcatgagccgcaacggcatcgatctgcgcctggctgactccaaggaagacgcgctggccatgctcaagctcaaggggattgccccggtcggcatcatgacccacttcccggtggaggagaaagaggacgtcaagatggggctggcccagttcaaactggactcccagtggctgctggaagcgggcaagctggatcgcagcaagatcaccatccacgccgccaactccttcgccaccctggaagtgccggacgcctacttcgacatggtgcgcccgggcggcctgctgtacggcgactccatcccctcctacaccgagtacaagcgggtgatggcgttcaagacccaggttgcctccgtcaaccactacccggccggcaacaccgtcggttatgaccgcaccttcaccctcaagcgcgactcctggctcgccaacctgccgctgggctactccgacggctatcgccgggcgctgagcaacaaggcctatgtgctgatccaaggccagaaagtgccggtggtgggcaagacctccatgaacaccatcatggtggacgtgaccgatctcaaaggggtcaaacccggtgacgaggtggtgctgttcggccgccagggtgaggctgaggtgaaacaggcggatctggaagagtacaacggcgccctgctggcggacatgtacaccatctggggctacaccaaccccaagaagatcaaccaa

SEQ ID NO: 178 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGGKGPKICAIMKADAYGHGIDLLVPSVVKAGIPCIGIASNEEARVAREKGFTGRLMRVRAATPAEVEQALPYKMEELIGSLVSAQGIADIAQRHHTNIPVHIALNSAGMSRNGIDLRLADSKEDALAMLKLKGIAPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINQ

SEQ ID NO: 179 - DNA, 1227 bp, Unknown
  Obtained from environmental sample
atgcacaagaagacactgctcgccacgctgatcctgggcctgctggccggtcaggccgtcgcggccccttacctgccgctggccagcgatcatcgcaacggcgaagtgcagaccgccagcaatgcctggctggaagtcgatctcggcgccttcgagcacaacatccagaccctcaaggatcgcctcggtgacaaagggccgaagatctgcgccatcatgaaggcagacgcctacggccacggcatcgacctgctggtcccctcggtggtcaaggctggcatcccctgcatcggcatcgccagcaacgaagaggcccgcgtggtccgcgagaagggcttcaccggccgcctgatgcgggtgcgtgccgccaccccggccgaagtggagcaggccctgccctacaagatggaagagctcatcggcagtctggtaagtgcccagggcatcgccgacatcgcccagcgccaccacaccaatatcccggtgcacatcgcgctcaactccgccggcatgagccgcaacggcatcgatctgcgcctggctgactccaaggaagacgcgctggccatgctcaagctcaaggggatcaccccggtcggcatcatgacccacttcccggtggaggagaaagaggacgtcaagatggggctggcccagttcaagctggactcccagtggctgctggaagcgggcaagctggatcgcagcaagatcaccatccacgccgccaactccttcgccaccctggaagtgccggacgcctacttcgacatggtacgcccgggcggcctgctgtacggtgactccatcccctcctacaccgagtacaagcgggtgatggcgttcaagacccaggttgcctccgtcaaccactacccggccggcaacaccgtcggttatgaccgcacctttaccctcaagcgcgactcctggctcgccaacctgccgctgggctactccgatggctatcgccgggcgctgagcaacaaggcctatgtgctgatccagggccagaaggtgccggtggtgggcaagacctccatgaacaccatcatggtggacgtcactgacctcaaaggggtcaaacccggtgacgaggtggtgctgttcggccgccagggtgaggccgaggtgaaacaggcggatctcgaggagtacaacggcgccctgctggcggacatgtacaccatctggggctacaccaaccccaagaagatcaagcgctga

SEQ ID NO: 180 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKGPKICAIMKADAYGHGIDLLVPSVVKAGIPCIGIASNEEARVVREKGFTGRLMRVRAATPAEVEQALPYKMEELIGSLVSAQGIADIAQRHHTNIPVHIALNSAGMSRNGIDLRLADSKEDALAMLKLKGITPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 181 - DNA, 1227 bp, Unknown
  Obtained from environmental sample
atgcacaagaagacactgctcgccacgctgatcctgggcctgctggccggtcaggccgtcgcggccccttacctgccgctggccagcgatcatcgcaacggcgaagtgcagaccgccagcaatgcctggctggaagtcgatctcggcgctttcgagcacaacatccagaccctcaaggatcgcctcggtgacaaagggccgaagatctgcgccatcatgaaggccgacgcctacggccacggcatcgacctgctggtgccctcggtggtcaaggccggcatcccctgcatcggcatcgccagcaacgaagaggcccgcgtggcccgcgagaagggcttcaccggccgcctgatgcgggtgcgtgccgccaccccggccgaagtggagcaggccctgccctacaagatggaagagctcatcggcagcctggtgagtgctcagggcatcgccgacatcgcccagcgccaccacaccaatatcccggtgcacatcgcgctcaactccgccggcatgagccgcaacggcatcgatctgcgcctggctgattccaaggaagacgcgctggccatgctcaagctcaaggggatcaccccggtcggtatcatgacccacttcccggtggaggagaaagaggacgtcaagatggggctggcccagttcaaactggactcccagtggctgctggaagcgggcaagctggatcgcagcaagatcaccatccacgccgccaactccttcgccaccctggaagtgccggacgcctacttcgacatggtgcgcccgggcggcctgctgtacggcgactccatcccctcctacaccgagtacaagcgggtgatggcgttcaagacccaggttgcctccgtcaaccactacccggccggcaacaccgtcggttatgaccgcaccttcaccctcaagcgcgactcctggctcgccaacctgccgctgggctactccgatggctatcgccgggcgctcagcaataaggcctatgtgctgacccagggccagaaggtgccggtggtgggcaagacctccatgaacaccatcacggtggacgtgaccgatctcaaaggggtcaaacccggtgacgaggtggtgctgttcggccgccagggtgaggccgaggtgaaacaggcggatctggaagagtacaacggcgccctgctggcggacatgtacaccatctggggctacaccaaccccaagaagatcaaccgctaa

SEQ ID NO: 182 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKGPKICAIMKADAYGHGIDLLVPSVVKAGIPCIGIASNEEARVAREKGFTGRLMRVRAATPAEVEQALPYKMEELIGSLVSAQGIADIAQRHHTNIPVHIALNSAGMSRNGIDLRLADSKEDALAMLKLKGITPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLTQGQKVPVVGKTSMNTITVDVTDLKGVKPGDEVVLFGRQGEAEVKQADLEEYNGALLADMYTIWGYTNPKKINR

SEQ ID NO: 183 - DNA, 1227 bp, Unknown
  Obtained from environmental sample
atgcacaagaagacactgctcgccacgctgatcctgggcctgctggccggtcaggccgtcgcggccccttacctgccgctggccagcgatcatcgcaacggcgaagtgcagaccgccagcaatgcctggctggaagtcgatctcggcgccttcgagcacaacatccagaccctcaaggatcgcctcggtgacaaagggccgaagatctgcgccatcatgaaggccgacgcctacggccacggcatcgatctgctggtgccctcggtggtcaaggccggcatcccctgcatcggcatcgccagcaatgaagaggcccgcgtggcccgtgagaaaggcttcaccggccgcctgatgcgggtacgtgccgccaccccggccgaagtggaacaggccctgccctacaagatggaggagctcatcggcagcctggtgagtgcccagggcatcgccgacatcgcccagcgccaccacaccaatatcccggtgcacatcgcactcaactccgccggcatgagccgcaacggcatcgatctgcgcctggctgactccaaggaagacgcgctggccatgctcaagctcaaggggatcaccccggtcggcatcatgacccacttcccggtggaggagaaagaggacgtcaagatggggctggcccagttcaaactggactcccagtggctgctggaagcgggcaagctggatcgcagcaagatcaccatccacgccgccaactccttcgccaccctggaagtgccggacgcctacttcgacatggtgcgcccgggcggcctgctgtacggtgactccatcccctcctacaccgagtacaagcgggtaatggcgttcaagacccaggttgcctccgtcaaccactacccggccggcaacaccgtcggttatgaccgcaccttcaccctcaagcgcgactcctggctcgccaacctgccgctgggctactccgacggctatcgccgggcgctgagcaacaaggcctatgtgctgatccagggccagaaggtgccggtggtgggcaagacctccatgaacaccatcatggtggacgtgaccgacctcaaaggggtcaaacccggtgacgaggtggtgctgttcggccgccagggtgaggccgaggtgaaacaggcggatctcgaggagtacaacggcgccctgctggcggacatgtacaccatctggggctacaccaaccccaagaagatcaaacgctga

SEQ ID NO: 184 - protein, 408 aa, Unknown; identical to SEQ ID NO: 144
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395

SEQ ID NO: 185 - DNA, 1227 bp, Unknown
  Obtained from environmental sample
atgcacaagaagacactgctcgcgaccctgatttttggcctgctggccggccaggcggtcgccgccccctatctgccgctcgccgacgaccaccgcaacggtcaggaacagaccgccgccaacgcctggctggaagtggatctcggtgccttcgagcgcaacatccagaccctgaagaatcgcctcggtgacaagggcccgcagatctgcgccatcatgaaggcggacgcctacggtcacggcatcgacctgctggtcccttccgtggtcaaggcaggcatcccctgcatcggcatcgccagcaacgaagaagcacgtgttgcccgcgagaagggcttcgaaggtcgcctgatgcgggtgcgtgccgccaccccggatgaagtggagcaagccctgccctacaagctggaagagctcatcggcagcctggagagcgccaaggggatcgccgacatcgcccagcgccatgacaccaacatcccggtgcacattggcctgaactccgccggcatgagccgcaacggcatcgatctgcgccaggacgatgccaaggccgatgccctggccatgctcaagctcaaggggatcaccccggtcggcatcatgacccacttcccggtggaggagaaagaggacgtcaagctggggctggcccagttcaagctggactaccagtggctcatcgacgccggcaagctggatcgcagcaagctcaccatccacgccgccaactccttcgccaccctggaagtgccggaagcctactttgacatggtgcgcccgggcggcatcatctatggcgacaccattccctcctacaccgagtacaagaaggtgatggcgttcaagacccaggtcgcctccgtcaaccactacccggcgggcaacaccgtcggctatgaccgcaccttcaccctcaagcgcgactccctgctggccaacctgccgatgggctactccgacggctaccgccgcgccatgagcaacaaggcctatgtgctgatccatggccagaaggcccccgtcgtgggcaagacttccatgaacaccaccatggtggacgtcaccgacatcaaggggatcaaacccggtgacgaggtggtcctgttcggacgccagggtgatgccgaagtgaaacaatctgatctggaggagtacaacggtgccctcttggcggacatgtacaccgtctggggctacaccaaccccaagaagatcaaccgctga

SEQ ID NO: 186 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
  SITE (354)...(357): N-glycosylation site. Prosite id = PS00001
MHKKTLLATLIFGLLAGQAVAAPYLPLADDHRNGQEQTAANAWLEVDLGAFERNIQTLKNRLGDKGPQICAIMKADAYGHGIDLLVPSVVKAGIPCIGIASNEEARVAREKGFEGRLMRVRAATPDEVEQALPYKLEELIGSLESAKGIADIAQRHDTNIPVHIGLNSAGMSRNGIDLRQDDAKADALAMLKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPMGYSDGYRRAMSNKAYVLIHGQKAPVVGKTSMNTTMVDVTDIKGIKPGDEVVLFGRQGDAEVKQSDLEEYNGALLADMYTVWGYTNPKKINR

SEQ ID NO: 187 - DNA, 1227 bp, Unknown
  Obtained from environmental sample
atgcacaagaagacactgcttgccacgctgatcctgggcctgctggccggtcaggccgtcgcggccccttacctgccgctggccagcgatcatcgcaacggcgaagtgcagaccgccagcaatgcctggctggaagtcgatctcggcgccttcgagcacaacatccagaccctcaaggatcgcctcggtgacaaaggaccgaagatctgcgccatcatgaaggccgacgcctacggccacggcatcgacctgctggttccctcggtggtcaaggccggcatcccctgcatcggcatcgccagcaacgaggaggcccgcgtggcccgcgagaagggcttcaccggccgcctgatgcgggtgcgtgccgccaccccggccgaagtggagcaggccctgccctacaagatggaagagctcatcggcagcctggtcagtgcccagggcatcgccgacatcgcccagcgccaccacaccaatatcccggtgcacatcgcgctgaactccgccggcatgagccgcaacggcatcgatctgcgtctggctgactccaaggcagacgcgctggccatgctcaagctcaaggggatcaccccggtcggcatcatgacccacttcccggtggaggagaaagaagacgtcaagatggggctggcccagttcaagctggactcccagtggctgctggaagcgggcaagctggatcgcagcaagatcaccatccacgccgccaactccttcgccaccctggaagtgccggacgcctacttcgacatggtgcgcccgggcggcctgctgtacggtgactccatcccctcctacaccgagtacaagcgggtgatggcgttcaagacccaggttgcctccgtcaaccactacccggccggcaacaccgtcggctatgaccgcaccttcaccctcaagcgcgactcctggctcgccaacctgccgctgggctactccgacggctatcgccgggcgctgagcaacaaggcctatgtgctgatccagggccagaaggtgccggtggtgggcaagacctccatgaacaccatcatggtggacgtgaccgatctcaagggggtcaaacccggtgacgaggtggtgctgttcggccgccagggtgaggccgaggtgaaacaggcggatctcgaggagtacaacggcgccctgctggcggacatgtacaccatctggggctacaccaaccccaagaagatcaaacgctaa

SEQ ID NO: 188 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKGPKICAIMKADAYGHGIDLLVPSVVKAGIPCIGIASNEEARVAREKGFTGRLMRVRAATPAEVEQALPYKMEELIGSLVSAQGIADIAQRHHTNIPVHIALNSAGMSRNGIDLRLADSKADALAMLKLKGITPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 189 - DNA, 1227 bp, Unknown
  Obtained from environmental sample
atgcacaagaagacactgctggccacgctgatcctgggcctgctggccggtcaggccgtcgcggccccttacctgccgctggccagcgatcatcgcaacggcgaagtgcagaccgccagcaatgcctggctggaagtcgatctcggcgccttcgagcacaacatccagaccctcaaggatcgcctcggtgacaaggggccgaagatctgcgccaccatgaaagcagacgcctacggccacggcatcgacctgctggtgccctcggtggtcaaggccggcatcccctgcatcggcatcgccagcaacgaagaggcccgcgtggcccgtgagaagggcttcaccggccgcctgatgcgggtacgtgccgccaccccggccgaagtggaacaggccctgccctacaagatggaagagctcatcggcagcctggtgagtgctcagggcatcgccgacatcgcccagcgccaccacaccaatatcccggtgcacatcgcgctcaactccgccggcatgagccgcaacggcatcgatctgcgcctggctgactccaaggaagacgcgctggccatgctcaagctcaaggggatcaccccggtcggcatcatgacccacttcccggtggaggagaaagaggacgtcaagatggggctggcccagttcaaactggactcccagtggctgctggaagcgggcaagctggatcgcagcaagatcaccatccacgccgccaactccttcgccaccctggaagtgccggacgcctacttcgacatggtgcgcccgggcggcctgctgtacggtgactccatcccctcctacaccgagtacaagcgggtgatggcgttcaagacccaggttgcctccgtcaaccactacccggccggcaacaccgtcggttatgaccgcaccttcaccctcaagcgcgactcctggctcgccaacctgccgctgggctactccgacggctatcgccgggcgttgagcaacaaggcttatgtgctgatccagggccagaaggtgccggtggtgggtaagacctccatgaacaccatcatggtggacgtgaccgatctgaaaggggtcaaacccggtgacgaggtggtgctgttcggccgccagggtgaagccgaggtgaaacaggcagatctggaagagtacaacggcgccctgctggcggacatgtacaccatctggggctacaccaaccccaagaagatcaatcgctga

SEQ ID NO: 190 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLGAFEHNIQTLKDRLGDKGPKICATMKADAYGHGIDLLVPSVVKAGIPCIGIASNEEARVAREKGFTGRLMRVRAATPAEVEQALPYKMEELIGSLVSAQGIADIAQRHHTNIPVHIALNSAGMSRNGIDLRLADSKEDALAMLKLKGITPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 191 - DNA, 1227 bp, Unknown
  Obtained from environmental sample
atgcacaagaagacactgcttgccaccctcgtcttcggcctgctggccggccaggcggtcgccgccccctacctgccgctcgccagcgacacccgcaacggtcaggagcagaccgcagccaacgcctggctggaagtggatctgggcgccttcgagcacaacatccagaccctcaaggatcgcctcggtgacaagggcccgcagatctgcgccatcatgaaggcggacgcctacggtcacggcatcgatctgctggtgccttccgtggtcaaggccaacatcccctgcatcggcatagccagcaacgaagaggcccgcgtggcccgtgagaagggcttcgaaggccggctgatgcgggtccgtgccgccaccccgaccgaggtggaacaggccctgccctacaagctggaagagctcatcggcagcctggagagtgccaagggcatctccgacatcgccctgcgccacaataccaaggccgcggttcaccttggcttgaactccgctggcatgagccgcaacggcatcgacctgcgccagtccggcgccaaggacgaggccctggccatgctcaagctgccgggtatcaccccggtcggcatcatgacccacttcccggtggaggagaaagaggacgtcaagctgggtctggcccagttcaagctggacagccagtggctgctggaagccggcaagctggatcgcagcaagatcaccatccatgccgccaactccttcgccaccctggaagtgcctgacgcctacttcgacatggtgcgcccgggcggcctgctgtacggcgactccatcccctcctacaccgagtacaagcgcgtcatggcgttcaagacccaggtcgcctcggtcaaccactacccggccggcaacaccgtcggctatgaccgcacctttaccctcaagcgcgactccctgctggcgaacctgccgctgggttactccgacggctatcgccgcgcgctcagcaacaaggcctatgtgctgatccagggtcagaaggtgcctgtggtcggcaggacctccatgaacaccatcatggtggacgtgaccgatctgaagggggtgaaacccggtgacgaggtggtgctgttcggccgccagggagaggccgaggtgaagcaggcggatctggaggagtacaacggcgccctgctggcggacgtgtacaccatctggggctacaccaaccccaagaagatcaatcgctga

SEQ ID NO: 192 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLGAFEHNIQTLKDRLGDKGPQICAIMKADAYGHGIDLLVPSVVKANIPCIGIASNEEARVAREKGFEGRLMRVRAATPTEVEQALPYKLEELIGSLESAKGISDIALRHNTKAAVHLGLNSAGMSRNGIDLRQSGAKDEALAMLKLPGITPVGIMTHFPVEEKEDVKLGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSLLANLPLGYSDGYRRALSNKAYVLIQGQKVPVVGRTSMNTIMVDVTDLKGVKPGDEVVLFGRQGEAEVKQADLEEYNGALLADVYTIWGYTNPKKINR

SEQ ID NO: 193 - DNA, 1227 bp, Unknown
  Obtained from environmental sample
atgcacaagaagacactgcttgccaccctcgtcttcggcctgctggccggccaggcggtcgccgccccctacctgccgctcgccagcgacacccgcaacggtcaggagcagaccgcagccaacgcctggctggaagtggatctgggcgccttcgagcacaacatccagaccctcaaggatcgcctcggtgacaagggcccgcagatctgcgccatcatgaaggcggacgcctacggtcacggcatcgatctgctggtgccttccgtggtcaaggccaacatcccctgcatcggcatagccagcaacgaagaggcccgcgtggcctgtgagaagggcttcgaaggccggctgatgcgggtccgtgccgccaccccgaccgaggtggagcaggccctgccctacaagctggaagagctcatcggcagcctggagagtgccaagggcatctccgacatcgccctgcgccacaacaccaaggtgccggtgcaccttggtctgaactccgccggcatgagccgcaacggcatcgacctgcgccaggccggcgccaaggaagagaccctggccatgctcaagctgccgggcatcaccccggtcggcatcatgacccacttcccggtggaggaaaaagaagacgtcaagctgggtctggcccagttcaagctggacagccagtggctgctggaagcgggcaagctggatcgcagcaagatcaccatccatgccgccaactccttcgccaccctggaagtgcctgacgcctacttcgacatggtgcgcccgggcggcctgctgtacggcgactccatcccctcctacaccgagtacaagcgcgtcatggcgttcaagacccaggtcgcctcggtcaaccactacccggccggcaacaccgtcggctatgaccgcaccttcaccctcaagcgtgactccctgctggcgaacctgccgctcggttactccgacggttatcgccgcgcgctcagcaacaaggcctatgtgctgatccagggtcggaaggtgcccgtggtcggcaagacctccatgaacaccatcatggtggacgtgaccgatctgaaaggggtgaaacccggcgacgaggtggtgctgtttggccgtcaaggtgaggccgaggtgaagcaggcggatctggaggagtacaacggcgccctgctggcggacatgtacaccatctggggctacaccaaccccaagaagatcaaacgctga

SEQ ID NO: 194 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLGAFEHNIQTLKDRLGDKGPQICAIMKADAYGHGIDLLVPSVVKANIPCIGIASNEEARVACEKGFEGRLMRVRAATPTEVEQALPYKLEELIGSLESAKGISDIALRHNTKVPVHLGLNSAGMSRNGIDLRQAGAKEETLAMLKLPGITPVGIMTHFPVEEKEDVKLGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSLLANLPLGYSDGYRRALSNKAYVLIQGRKVPVVGKTSMNTIMVDVTDLKGVKPGDEVVLFGRQGEAEVKQADLEEYNGALLADMYTIWGYTNPKKIKR

SEQ ID NO: 195 - DNA, 1227 bp, Unknown
  Obtained from environmental sample
atgcacaagaagacactgctcgccaccctcgtcttcggcctgctggccggccaggcggtcgccgccccctacctgccgctcgccagcgacacccgcaacggtcaggagcaaaccgccgccaacgcctggctggaagtggatctgggcgccttcgagcacaacatccagaccctcaaggatcgcctcggtgacaagggcccgcagatctgcgccatcatgaaggcggacgcctacggtcacggcatcgatctgctggtgccctcggtggtcaaggccaacatcccctgcatcggcatcgccagcaacgaagaggcccgggtggctcgggagaaaggcttcgaaggccgactgatgcgggtccgtgccgccaccccgaccgaggtggagcaggccctgccctacaagctcgaagagctcatcggcagcctggagagtgccaagggcatctccgacatcgccctgcgccacagcaccaaggtgccggtgcacatcggtctgaactccgccggcatgagccgcaacggcatcgacctgcgccagtccggcgccaaggacgaggccctgaccatgctcaagctgccgggcatcaccccggtcggcatcatgacccacttcccggtggaggagaaagaggacgtcaagctgggtctggcccagttcaagctggacagccagtggctgctggaagcgggcaagctggatcgcagcaagatcaccatccatgccgccaactccttcgccactctggaagtgcctgacgcctacttcgacatggtgcgcccgggcggcctgctgtacggcgactccatcccctcctacaccgagtacaagcgcgtgatggcgttcaagacccaggtcgcctcggtcaaccgctacccggccggcaacaccgtcggctatgaccgcaccttcaccctcaagcgtgactccctgctggcgaacctgccgctcggttactccgacggttatcgccgcgcgctcagcaacaaggcctatgtgctgatccagggtcagaaggtgcctgtggtcggcaagacctccatgaacaccatcatggtggacgtgaccgacctgaagggagtgaaacccggtgacgaggtggtgctgtttggccgccagggagaggccgaggtgaaacaggcggatctggaggagtacaacggcgccctgctggcggacatgtacaccatctggggctacaccaaccccaagaagatcaaacgctga

SEQ ID NO: 196 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLGAFEHNIQTLKDRLGDKGPQICAIMKADAYGHGIDLLVPSVVKANIPCIGIASNEEARVAREKGFEGRLMRVRAATPTEVEQALPYKLEELIGSLESAKGISDIALRHSTKVPVHIGLNSAGMSRNGIDLRQSGAKDEALTMLKLPGITPVGIMTHFPVEEKEDVKLGLAQFKLDSQWLLEAGKLDRSKITIHAANSFATLEVPDAYFDMVRPGGLLYGDSIPSYTEYKRVMAFKTQVASVNRYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 197 - DNA, 1227 bp, Unknown
  Obtained from environmental sample
atgcacaagaagacactgctagcgaccctggtcttcgggttgctcgccggacaggccgtcgccgccccctatctgccgctggccagtgacacccgcaacggccaggagcagaccgccgccaacgcctggctggaagtggatttgaccgccttcgagcacaacatccagaccctcaaggatcgtctcggcgacaagggcccgcagatctgcgccatcatgaaggcggacgcctacggccacggcatcgatctgctggtgccctccgtggtcaaagcgggcattccctgcatcggcatcgccagcaatgaagaggcacgcgtggcccgcgagaagggcttcgaggggcgcctgatgcgggtccgtgccgccaccccggtcgaggtagagcaggcgctgccctacaagctggaagagctggtaggcagcctggagagcgccaaggggatcgccgacatcgcacagcgccataacactaacgtgtcggtgcacatcggcctgaactccgccggcatgagccgcaacggcatcgacctgcgccagaatgacgccaaggccgatgccctggccatgctgaaactgaaggggatcaccccggtcggcatcatgacccacttcccggtggaggagaaagaggacgtcaagctggggctggcccagttcaagcttgactaccagtggctgatcgacgccggcaagctggatcgcagcaagctcaccatccacgccgccaactccttcgccaccctggaagtgccggaagcctactttgacatggtacgcccgggcggcatcatctacggtgacaccatcccctcctacaccgagtacaagaaggtgatggcgttcaagacccaggtcgcctccgtcaaccactacccggcgggcaacaccgtcggttatgaccgcaccttcaccctcaagcgcgactccctgctcgccaacctgccgctcggttactccgacggataccgccgtgcgctgagcaacaaggcctatgtgctgatccagggccagaaggtgcccgtggtgggcaagacctccatgaataccatcatggtggacgtgaccgacctcaaaggggtgaaacccggtgatgaagtggtgctgttcggccgtcagggtgaggccgaggtgaagcaggcggatctggaggagtacaacggcgccctgctggcggacatgtacaccatctggggttacaccaaccccaagaagatcaatcgctga

SEQ ID NO: 198 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
  SITE (161)...(164): N-glycosylation site. Prosite id = PS00001
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCIGIASNEEARVAREKGFEGRLMRVRAATPVEVEQALPYKLEELVGSLESAKGIADIAQRHNTNVSVHIGLNSAGMSRNGIDLRQNDAKADALAMLKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 199 - DNA, 1227 bp, Unknown
  Obtained from environmental sample
atgcacaagaagacactgctagcgaccctgatctttggcctgctggccggccaggcggtcgccgccccctacctgccgctcgccgacgaccaccgcaacggtcaggaacagaccgccgccaacgcctggctggaagtggatctcggtgccttcgagcacaacatccagaccctgaagaatcgcctcggtgacaagggcccgcagatctgcgccatcatgaaggcggacgcctacggtcacggcatcgacctgctggtcccttccgtggtcaaggcaggcatcccctgcatcggcatcgccagcaacgaagaagcacgtgttgcccgcgagaagggcttcgaaggtcgcctgatgcgggtgcgtgccgccaccccggatgaagtggagcaggccctgccctacaagctggaagagctcatcggcagcctggagagcgccaaggggatcgccgacatcgcccagcgccatcacaccaacatcccggtgcacatcggcctgaactccgccggcatgagccgcaacggcatcgatctgcgccaggacggtgccaaggccgatgccctggccatgctcaagctcaaggggatcaccccggtcggcatcatgacccactttccggtggaggagaaagaggacgtcaagctggggctggcccagttcaagctggactaccagtggctcatcgacgccggcaagctggatcgcagcaagctcaccatccacgccgccaactccttcgccaccctggaagtgccggaagcctactttgacatggtgcgcccgggcggcatcatctatggcgacaccattccctcctacaccgagtacaagaaggtgatggcgttcaagacccaggtcgcctccgtcaaccactacccggcgggcaacaccgtcggctatgaccgcaccttcaccctcaagcgcgactccctgctggccaacctgccgatgggctactccgacggctaccgccgcgccatgagcaacaaggcctatgtgctgatccatggccagaaggcccccgtcgtgggcaagacctccatgaacaccaccatggtggacgtcaccgacatcaaggggatcaaacccggtgacgaggtggtcctgttcggacgccagggtgatgccgaggtgaaacaatccgatctggaggagtacaacggtgccctcttggcggacatgtacaccgtctggggctacaccaaccccaagaagatcaaacgctga

SEQ ID NO: 200 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
  SITE (354)...(357): N-glycosylation site. Prosite id = PS00001
MHKKTLLATLIFGLLAGQAVAAPYLPLADDHRNGQEQTAANAWLEVDLGAFEHNIQTLKNRLGDKGPQICAIMKADAYGHGIDLLVPSVVKAGIPCIGIASNEEARVAREKGFEGRLMRVRAATPDEVEQALPYKLEELIGSLESAKGIADIAQRHHTNIPVHIGLNSAGMSRNGIDLRQDGAKADALAMLKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPMGYSDGYRRAMSNKAYVLIHGQKAPVVGKTSMNTTMVDVTDIKGIKPGDEVVLFGRQGDAEVKQSDLEEYNGALLADMYTVWGYTNPKKIKR

SEQ ID NO: 201 - DNA, 1227 bp, Unknown
  Obtained from environmental sample
atgcacaagaagacactgctagcgaccctgatctttggcctgctggccggccaggcggtcgccgccccctatctgccgctcgccgacgaccaccgcaacggtcaggaacagaccgccgccaacgcctggctggaagtggatctcggtgccttcgagcacaacatccagaccctgaagaatcgcctcggtgacaagggcccgcagatctgcgccatcatgaaggcggacgcctacggtcacggcatcgacctgctggtcccttccgtggtcaaggcaggcatcccttgcatcggcatcgccagcaacgaagaagcacgtgttgctcgcgagaagggcttcgaaggtcgcctgatgcgggtgcgggccgccaccccggatgaagtggagcaggccctgccctacaagctggaggagctcatcggcagcctggagagcgccaaggggatcgccggcatcgcccagcgccatcacaccaacatcccggtgcacatcggcctgaactccgccggcatgagccgcaacggcatcgatctgcgccaggacgatgccaaggccgatgccctggccatgctcaagctcaaggggatcaccccggtcggcatcatgacccacttcccggtggaggagaaagaggacgtcaagctggggctggcccagttcaagctggactaccagtggctcatcgacgccggcaagctggatcgcagcaagctcaccatccacgccgccaactccttcgccaccctggaagtgccggaagcctactttgacatggtgcgcccgggcggcatcatctatggcggcaccattccctcctacaccgagtacaagaaggtgatggcgttcaagacccaggtcgcctccgtcaaccactacccggcgggcaacaccgtcggctatgaccgcaccttcaccctcaagcgcgactccctgctggccaacctgccgatgggctactccgacggctaccgccgcgccatgagcaacaaggcctatgtgctgatccatggccagaaggcccccgtcgtgggcaagacttccatgaacaccaccatggtggacgtcaccgacatcaaggggatcaaacccggtgacgaggtggtcctgttcggacgccagggtgatgctgaggtgaaacaatctgatctggaggagtacaacggtgccctcttggcggacatgtacaccgtttggggctacaccaaccccaagaagatcaatcgctaa

SEQ ID NO: 202 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
  SITE (354)...(357): N-glycosylation site. Prosite id = PS00001
MHKKTLLATLIFGLLAGQAVAAPYLPLADDHRNGQEQTAANAWLEVDLGAFEHNIQTLKNRLGDKGPQICAIMKADAYGHGIDLLVPSVVKAGIPCIGIASNEEARVAREKGFEGRLMRVRAATPDEVEQALPYKLEELIGSLESAKGIAGIAQRHHTNIPVHIGLNSAGMSRNGIDLRQDDAKADALAMLKLKGITPVGIMTHFPVEEKEDVKLGLAQFKLDYQWLIDAGKLDRSKLTIHAANSFATLEVPEAYFDMVRPGGIIYGGTIPSYTEYKKVMAFKTQVASVNHYPAGNTVGYDRTFTLKRDSLLANLPMGYSDGYRRAMSNKAYVLIHGQKAPVVGKTSMNTTMVDVTDIKGIKPGDEVVLFGRQGDAEVKQSDLEEYNGALLADMYTVWGYTNPKKINR

SEQ ID NO: 203 - DNA, 1227 bp, Unknown
  Obtained from environmental sample
atgcacaagaagacactgctagcgaccctgatcttcgggctgctcgccggtcaggcggtcgccgccccctatctgccgctcgccagcgacacccgcaacggccaggagcagaccgccaccaacgcctggctggaagtggacctgaccgccttcgaacacaacatccagaccctcaaggatcgcctgggtgacaaggggccgcagatctgcgccatcatgaaggcggacgcctacggccacggcattgacctgctggtcccctccgtggtcaaggcgggcatcccctgcatcggcatcgccagcaatgaagaggcccgggtggcccgcgagaagggcttcgaaggccggctgatgcgggtccgtgccgccaccccggccgaggtggagcaggccctgccctacaagctggaagagctggtaggcagcctggccagcgcccaggggatcgccgacatcgcccagcgccaccacaccaccatcccggtgcacatcggtctgaactccgccggcatgagccgcaacggcatcgatctgcgcctggcggactccaaggaagatgccctggccatgctcaagctcaaggggatcaccccggtcggcatcatgacccacttcccggtggaggagaaagaggacgtcaagctggggctggcccagttcaagctggactaccagtggctcatcgacgcgggcaagctggatcgcagcaagctcaccatccatgccgccaactccttcgccaccctggaagtgccggaagcctacttcgacatggtgcgcccgggcggcatcatctatggcgacaccatcccctcctacaccgagtacaagaaggtgatggcgttcaagacccaggtcgcctcggtgaatcactacccggcgggcaacaccgtcggctatgaccgcaccttcaccctcaagcgcgactccctgctcgccaacttgccgctcgactactccgacggctatcgccgggcgctcagcaacaaggcctatgtgctgatccagggccagaaggtgcctgtggtgggcaagacctccatgaacaccatcatggtggacgtgaccgatctcaagggggtcaaacccggtgacgaggtggtgctgttcggccgccagggtgacgccgaggtgaagcagtctgacctggaagagtacaacggcgccctgctggcggacatgtacaccgtctggggctacaccaaccccaagaagatcaatcgctga

SEQ ID NO: 204 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLIFGLLAGQAVAAPYLPLASDTRNGQEQTATNAWLEVDLTAFEHNIQTLKDRLGDKGPQICAIMKADAYGHGIDLLVPSVVKAGIPCIGIASNEEARVAREKGFEGRLMRVRAATPAEVEQALPYKLEELVGSLASAQGIADIAQRHHTTIPVHIGLNSAGMSRNGIDLRLADSKEDALAMLKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLDYSDGYRRALSNKAYVLIQGQKVPVVGKTSMNTIMVDVTDLKGVKPGDEVVLFGRQGDAEVKQSDLEEYNGALLADMYTVWGYTNPKKINR

SEQ ID NO: 205 - DNA, 1227 bp, Unknown
  Obtained from environmental sample
atgcacaagaagacactgctagcgaccctgatctttggcctgctggccggccaggcggtcgccgccccctacctgccgctcgccaacgaccaccgcaacggtcaggaacagaccgccgccaacgcctggctggaagtggatctcggtgccttcgagcacaacatccagaccctgaagaatcgcctcggtgacaagggcccgcagatctgcgccgtcatgaaggcggacgcctacggtcacggcatcgacctgctggtcccttccgtggtcaaggcaggcatcccctgcatcggcatcgccagcaacgaagaagcacgtgttgcccgcgagaagggcttcgaaggtcgcctgatgcgggtgcgtgccgccaccccggatgaagtggagcaggccctgccctacaagctggaagagctcatcggcagcctggagagcgccaaggggatcgccgacatcgcccagcgccatgacaccaacatcccggtgcacattggcctgaactccgccggcatgagccgcaacggcatcgatctgcgccaggacgatgccaaggccgatgccctggccatgctcaagctcaaggggatcaccccggtcggcatcatgacccacttcccggtggaggagaaagaggacgttaagctggggctggcccagttcaagctggactaccagtggctcatcgacgccggcaagctggatcgcagcaagctcaccatccacgccgccaactccttcgccaccctggaagtgccggaagcctactttgacatggtgcgcccgggcggcatcatctatggcgacaccattccctcctacaccgagtacaagaaggtgatggcgttcaagacccaggtcgcctccgtcaaccactacccggcgggcaacaccgtcggctatgaccgcaccttcaccctcaagcgcgactccctgctggccaacctgccgatgggctactccgacggctaccgccgcgccatgagcaacaaggcctatgtgctgatccatggccagaaggcccccgtcgtgggcaagacctccatgaacaccaccatggtggacgtcaccgacatcaaggggatcaaacccggtgacgaggtggtcctgttcggacgccagggtgatgccgaagtgaaacaatccgatctggaggagtacaacggtgccctcttggcggacatgtacaccgtctggggctacaccaaccccaagaagatcaaccgctaa

SEQ ID NO: 206 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
  SITE (354)...(357): N-glycosylation site. Prosite id = PS00001
MHKKTLLATLIFGLLAGQAVAAPYLPLANDHRNGQEQTAANAWLEVDLGAFEHNIQTLKNRLGDKGPQICAVMKADAYGHGIDLLVPSVVKAGIPCIGIASNEEARVAREKGFEGRLMRVRAATPDEVEQALPYKLEELIGSLESAKGIADIAQRHDTNIPVHIGLNSAGMSRNGIDLRQDDAKADALAMLKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPMGYSDGYRRAMSNKAYVLIHGQKAPVVGKTSMNTTMVDVTDIKGIKPGDEVVLFGRQGDAEVKQSDLEEYNGALLADMYTVWGYTNPKKINR

SEQ ID NO: 207 - DNA, 1221 bp, Unknown
  Obtained from environmental sample
atgcacaagaagacactgctagcgaccctggtcttcgggttgctcgccggccaggccgtcgccgccccctacctgccgctcgccagcgacacccgcaacggtcaggagcagaccgccgccaacgcctggctggaggtggacttgaccgccttcgagcacaacatccagaccctcaaggatcgtctcggcgacaagggcccgcagatctgcgccatcatgaaggccgacgcctacggtcatggcatcgatctgctggtcccctccgtggtcaaggcaggcattccctgcatcggcatcgccagcaatgaagaggcccgcgtggcccgcgagaagggcttcgagggccgcctgatgcgggtccgtgcagccaccccggccgaagtggaacaggccctaccctacaagctggaagagctggtgggcagcctggagagcgccaaggggatcgccgacatcgcccagcgccaccataccaccattccggtgcacataggtctgaactccgccggcatgagccgcaacggcatcgacctgcgccaggcggacgccaaggaagatgccctggccatggtcaagctcaaggggatcaccccggtcggcatcatgacccacttcccggtggaggagaaagaggacgtcaagctggggctggcccagttcaagctggactaccagtggctgatcgatgcgggcaagctggatcgcagcaagctcaccatacacgccgccaactccttcgccaccctggaagtgccggaagcctactttgacatggtgcgcccgggcggcatcatctacggtgacaccatcccctcctacaccgaatacaagaaggtgatggcgttcaagacccaggtcgcctcggtgaatcactacccggcgggcaacaccgtcggctatgaccgcaccttcaccctcaagcgcgactcccagctcgccaacctgccgctgggttactccgatggctaccgccgtgcgctcagcaacaaggcctatgtgctgatccagggccagaaggtgcccgtggtgggcaagacctccatgaacaccatcatggtggacgtgaccgacctcaaaggggtgaaacccggtgatgaagtggtgctgttcggccgtcagggtgaggccgaggtgaagcaggcggatctggaggagtacaacggcgccctgctggcggacatgtacaccatctggggttacaccaaccccaagaagatcaac

SEQ ID NO: 208 - protein, 407 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCIGIASNEEARVAREKGFEGRLMRVRAATPAEVEQALPYKLEELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSQLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIN

SEQ ID NO: 209 - DNA, 1224 bp, Unknown
  Obtained from environmental sample
atgcacaagaagacactgcttgcgaccctggtcttcgggttgctcgccggccaggccgtcgccgccccctacctgccgctcgccagcgacacccgcaacggtcaggagcagaccgccgccaacgcctggctggaggtggacttgaccgccttcgagcacaacatccagaccctcaaggatcgtctcggcgacaagggcccgcagatctgcgccatcatgaaggccgacgcctacggtcacggcatcgatctgctggtcccctccgtggtcaaggcgggcattccctgcatcggcatcgccagcaatgaagaggcccgcgtggcccgcgagaagggcttcgagggccgcctgatgcgggtccgtgccgccaccccggccgaagtggaacaggccctgccctacaagctgggagagctggtgggcagcctggagagcgccaaggggatcgccgacatcgcccagcgccaccataccaccattccggtgcacataggtctgaactccgccggcatgagccgcaacggcatcgacctgcgccaggcggacgccaaggaagatgccctggccatggtcaagctcaaggggatcaccccggtcggcatcatgacccacttcccggtggaggagaaagaggacgtcaagctggggctggcccagttcaagctggactaccagtggctgatcgacgcgggcaagctggatcgcagcaagctcaccatacacgccgccaactccttcgccaccctggaagtgccggaggcctactttgacatggtacgcccgggcggcatcatctacggtgacaccatcccctcctacaccgaatacaagaaggtgatggcgttcaagacccaggtcgcctcggtgaaccactacccggcgggcaacaccgtcggctatgaccgcaccttcaccctcaagcgcgactccctgctcgccaacctgccgctgggttactccgacggctaccgccgtgcgctgagcaacaaggcctatgtgctgatccagggccagaaggtgcccgtggtgggcaagacctccatgaacaccatcatggtggacgtgaccgacctcaaaggggtgaaacccggtgacgaagtggtgctgttcggccgtcagggtgaggccgaggtgaagcaggcggatctggaggagtacaacggcgccctgctggcggacatgtacaccatctggggttacaccaaccccaagaagtcaaccgct

SEQ ID NO: 210 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCIGIASNEEARVAREKGFEGRLMRVRAATPAEVEQALPYKLGELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKSTA

SEQ ID NO: 211 - DNA, 1221 bp, Unknown
  Obtained from environmental sample
atgcacaagaagacactgctagcgaccctggtcttcgggttgctcgccggacaggccgtcgccgccccctatctgccgctggccagtgacacccgcaacggccaggagcagaccgccgccaacgcctggctggaagtggatttgaccgccttcgagcacaacatccagaccctcaaggatcgtctcggcgacaagggcccgcagatctgcgccatcatgaaggcggacgcctacggccacggcatcgatctgctggtgccctccgtggtcaaagcgggcattccctgcatcggcatcgccagcaatgaagaggcacgcgtggcccgcgagaagggcttcgaggggcgcctgatgcgggtccgtgccgccaccccggtcgaggtagagcaggcgctgccctacaagctggaagagctggtgggcagcctggagagcgccaaggggatcgccgacatcgcccagcgccaccataccaccattccggtgcacataggtctgaactccgccggcatgagccgcaacggcatcgacctgcgccaggcggacgccaaggaagatgccctggccatggtcaagctcaaggggatcaccccggacggcatcatgacccacttcccggtggaagagaaagaggacgtcaagctggggctggcccagttcaagctggactaccagtggctgatcgacgccggcaagctggatcgcagcaagctcaccatccacgccgccaactccttcgccaccctggaagtgccggaagcctactttgacatggtacgcccgggcggcatcatctacggtgacaccatcccctcctacaccgagtacaagaaggtgatggcgttcaagacccaggtcgcctccgtcaaccactacccggcgggcaacaccgtcggttatgaccgcaccttcaccctcaagcgcgactccctgctcgccaacctgccgatgggttactccgacggctaccgccgcgccatgagcaacaaggcctatgtgctgatccatggccagaaggcccctgtggtgggcaagacctccatgaacaccaccatggtggacgtgaccgacatcaaggggatcaaacccggtgacgaggtggtgctgttcggccgtcagggggatgccgaagtgaagcagtctgatctggaagagtacaacggcgctctgctggcggacatgtacaccgtctggggctacaccaaccccaagaagatcaac

SEQ ID NO: 212 - protein, 407 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
  SITE (354)...(357): N-glycosylation site. Prosite id = PS00001
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCIGIASNEEARVAREKGFEGRLMRVRAATPVEVEQALPYKLEELVGSLESAKGIADIAQRHHTTIPVHIGLNSAGMSRNGIDLRQADAKEDALAMVKLKGITPDGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPMGYSDGYRRAMSNKAYVLIHGQKAPVVGKTSMNTTMVDVTDIKGIKPGDEVVLFGRQGDAEVKQSDLEEYNGALLADMYTVWGYTNPKKIN

SEQ ID NO: 213 - DNA, 1221 bp, Unknown
  Obtained from environmental sample
atgcacaagaagacactgcttgcgaccctggtcttcgggttgctcgccggccaggccgtcgccgccccctatctgcccctggccagcgacacccgcaacggtcaggagcagaccgccgccaacgcctggctggaggtggacttgaccgccttcgagcacaacatccagaccctcaaggatcgtctgggcggcaagggcacgcagatctgcgccatcatgaaggccgacgcctacggtcacggcatcgatctgctggtcccctccgtggtcaaggcgggcattccctgcatcggcatcgccagcaatgaagaggcccgcgtggcccgcgagaagggcttcgagggccgcctgatgcgggtccgtgccgccaccccggccgaagtggaacaggccctgccctacaagctggaagagctggtgggcagcctggagagcgccaaggggatcgccgacatcgcccagcgccaccataccaccattccggtgcacataggtctgaactccgccggcatgagccgcaacggcatcgatcttcgccaggcggacgccaaggaagatgccctggccatggtcaagctcaaggggatcaccccggtcggcatcatgacccacttcccggtggaggagaaggaggacgtcaagctggggctggcccagttcaagctggactaccagtggctgatcgacgcgggcaagctggatcgcagcaagctcaccatacacgccgccaactccttcgccaccctggaagtgccggaagcctactttgacatggtgcgcccgggcggcatcatctacggtgacaccatcccctcctacaccgaatacaagaaggtgatggcgttcaagacccaggtcgcctcggtgaaccactacccggcgggcaacaccgtcggctatgaccgcaccttcaccctcaaacgtgactcctggctcgccaacctgccgctcggttactccgacggctatcgccgtgcgctcagcaacaaggcctatgtgctgatccagggtcagaaggtgccggtggtcggcaagacctccatgaacaccatcatggtggacgtgaccgatctcaaaggggtaaagcccggtgatgaagtggtgctgtttggccgtcagggtgaggcagaagtgaaacaggctgatctggaggagtacaacggcgccctgttggcggacatgtacaccatctggggctacaccaaccccaagagatcaaac

SEQ ID NO: 214 - protein, 407 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLTAFEHNIQTLKDRLGGKGTQICAIMKADAYGHGIDLLVPSVVKAGIPCIGIASNEEARVAREKGFEGRLMRVRAATPAEVEQALPYKLEELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKRSN

SEQ ID NO: 215 - DNA, 1227 bp, Unknown
  Obtained from environmental sample
atgcacaagaagacactgctagccaccttgatcctgggcctgctggccggtcaagccgtcgcagccccctatctgccgcaggcgagcgatcatcgcaacggcgaagtacaaaccgccagcaacgcctggttggaagtggatctgggcgccttcgaacacaatatccagaccctcaaggatcgcctcggtgacaagggtccgcagatctgcgccatcatgaaggccgacgcctacggtcatggcatcgacctgctggtcccctccgtggtcaaggccaatatcccctgtatcggcatcgccagcaacgaagaggcccgcgtcgctcgcgagaaggggtttaccggtcgcctgatgcgggtgcgcgccgccactcctgtcgaagtggaacaggccctgccctacaagctggaagagctggttggcagcctggtgagtgctcaggggatctcagacatcgccctgcgccacaatacccggatcccggtgcatattggcctcaactccgccggcatgagccgcaacggcatagacctgcgtctggccgattccaaacaagatgcgctgaccatgctcaagctcaaggggatcaccccggtcggcatcatgacccacttcccggtagaggagaaagaggacgtcaagatggggctggcccagttcaaactggactcccagtggctgctggaagcgggcaagctggatcgcagcaagatcaccatccacgccgccaactccttcgccaccctggaagtgccggatgcctacttcgacatggtgcgcccgggtggcctgctctacggcgactccatcccctcctacaccgaatacaagcgggtgatggcattcaagacccaggtcgcctcggtcaaccactacccggcaggcaactccgtcggctatgaccgcacctttaccctcaaacgtgactccctgctcgccaacctgccgctcggttactccgacggctatcgccgtgcgctgagcaacaaggcctatgtactgatccagggtcagaaggtacctgtggtgggcaagacctccatgaacaccatcatggtggacgtgaccgatctcaaaggggtgaaacccggtgatgaagtggtgctgtttggccgtcagggtgaggccgaagtgaaacaggccgatctggaggagtacaacggtgccctgctggcggacatgtacaccatctggggctacaccaaccccaagaagatcaagcgctaa

SEQ ID NO: 216 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPQASDHRNGEVQTASNAWLEVDLGAFEHNIQTLKDRLGDKGPQICAIMKADAYGHGIDLLVPSVVKANIPCIGIASNEEARVAREKGFTGRLMRVRAATPVEVEQALPYKLEELVGSLVSAQGISDIALRHNTRIPVHIGLNSAGMSRNGIDLRLADSKQDALTMLKLKGITPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 217 - DNA, 1221 bp, Unknown
  Obtained from environmental sample
atgcacaagaagacactgctagcgaccctggtcttcgggttgctcgccggccaggccgtcgccgccccctacctgccgctcgccagcgacacccgcaacggtcaggagcagaccgccgccaacgcctggctggaggtggacttgaccgccttcgagcacaacatccagaccctcaaggatcgtctcggcgacaagggcccgcagatctgcgccatcatgaaggcggacgcctacggccacggcatcgatctgctggtgccctccgtggtcaaggcgggcattccctgcatcggcatcgccagcaatgaagaggcccgcgtggcccgcgagaagggcttcgagggccgcctgatgcgggtccgtgccgccaccccggttgaggtagagcaggcgctgccctacaagctggaagagctggtaggcagcctggagagcgccaaggggatcgccgacatcgcccagcgccaccataccaccattccggtgcacataggtctgaactccgccggcatgagccgcaacggcatcgacctgcgccaggcggacgccaaggaagatgccctggccatggtcaagctcaaggggatcaccccggtcggcatcatgacccacttcccggtggaagagaaagaggacgtcaagctggggctggcccagttcaagctggactaccagtggctgatcgacgcgggcaagctggatcgcagcaagctcaccatacacgcagccaactccttcgccaccctggaagtgccggacgcctactttgacatggtacgcccgggcggcatcatctacggtgacaccatcccctcctacaccgaatacaagaaggtgatggcgttcaagacccaggtcgcctcggtgaatcactacccggcgggcaacaccgtcggctatgaccgcaccttcaccctcaagcgcgactccctgctcgccaacctgccgctgggttactccgacggctaccgccgtgcgctcagcaacaaggcctatgtgctgatccagggccagaaggtgcccgtggtgggcaagacctccatgaacaccatcatggtggacgtgaccgacctcaaaggggtgaaacccggtgatgaagtggtgctgtttggccgtcagggtgaggccgaggtgaagcaggcggatctggaggagtacaacggcgccctgctggcggacatgtacaccatctggggttacaccaaccccaagaagatcaat

SEQ ID NO: 218 - protein, 407 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCIGIASNEEARVAREKGFEGRLMRVRAATPVEVEQALPYKLEELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPDAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIN

SEQ ID NO: 219 - DNA, 1227 bp, Unknown
  Obtained from environmental sample
atgcacaagaagacactgctcgccaccttgatcctgggcctgctggccggtcaagccgtcgcagccccctatctgccgcaggcgagcgataatcgcaacggcgaagtacaaaccgccagcaacgcctggctggaagtagacctgaccgcgtttgaacagaacctgcagactctcaagacccgcctcggcgacaagggcccgcagatctgcgccatcatgaaggcggatgcctacggtcacggcatcgatctgctggttccctccgtcatcaaggccgagatcccctgtatcggcatcgccagcaacgaagaggcccgcgtcgctcgcgagaaaggctttaccggtcgcctgatgcgggtgcgcgccgccactcctgtcgaagtggaacaggccctgccctacaagctggaagagctggttggcagcctggtgagtgctcaggggatctccgacatcgccctgcgccacaatacccggatcccggtgcatattggcctcaactccgccggcatgagccgcaacggcatagacctgcgtctggccgattccaagcaagatgcgctggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggaggcctactttgacatggtgcgcccgggcggcctcatctacggcgactccatcccctcctacaccgaatacaaacgggtgatggcattcaagacccaggtggcgtcggttaaccactatgcggcaggcaactccgtcggctatgaccgcacctttaccctcaagcgcgactccctgctcgccaacctgccgctcggttactccgacggctatcgccgtgcgctgagcaacaaggcctatgtactgatccagggtcagaaggtacctgtggtgggcaagacctccatgaacaccatcatggtggacgtgaccgatctcaaaggggtgaaacccggtgatgaagtggtgctgtttggccgtcagggtgaggccgaagtgaaacaggccgatctcgaggagtacaacggtgccctgctggcggacatgtacaccatctggggctacaccaaccccaagaagatcaaacgctaa

SEQ ID NO: 220 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPQASDNRNGEVQTASNAWLEVDLTAFEQNLQTLKTRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIDLRLADSKQDALAMLKLKGITPVGIMTHFPVEEKEDVKLGLAQFKLDSQWLIEAGKLDRSKLTIHAANSFATLEVPEAYFDMVRPGGLIYGDSIPSYTEYKRVMAFKTQVASVNHYAAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 221 - DNA, 1221 bp, Unknown
  Obtained from environmental sample
atgcacaagaagacactgctagccaccttgatcctgggcctgctggccggtcaagccgtcgcagccccctatctgccgcaggcgagcgataatcgcaacggcgaagtacaaaccgccagcaacgcctggctggaagtagacctgaccgcgtttgaacagaacctgcagactctcaagacccgccccggcgacaagggcccgcagatctgcgccatcatgaaggcggatgcctacggtcacggcatcgatctgctggttccctccgtcatcaaggccgagatcccctgtatcggcatcgccagcaacgaagaggcccgcgtcgctcgcgagaagggctttaccggtcgcctgatgcgggtgcgcgccgccactcctgtcgaagtggaacaggccctgccctacaagctggaagagctggttggcagcctggtgagtgctcaggggatctccgacatcgccctgcgccacaatacccggatcccggtgcatattggcctcaattccgccggcatgagccgcaacggcatagacctgcgtctaaccgattccaagcaagatgcgctggccatgctcaaactcaaggggatcaccccggtcggcatcatgacccacttcccggtggaggagaaagaggacgtcaagctggggctggcccagttcaagctggactcccagtggctgctggaagcaggcaagctggatcgcagcaagatcaccatccatgccgccaactccttcgccaccctggcagtgccggacgcctactttgacatggtgcgcccgggcggcctgctctacggcgactccatcccctcctacaccgaatacaagcgggtgatggcattcaagacccaggtggcgtcggtcaaccactatccggcaggcaactccgtcggctatgaccgcacttttaccctcaagcgtgactccctgctcgccaacctgccgctcggttactccgacggctatcgccgtgcgctcagcaacaaggcctatgtactgatccagggtcagaaggtacctgtggtgggcaagacctccatgaacaccatcatggtggacgtgaccgatctcaaaggggtgaaacccggtgatgaagtggtgctgtttggccgtcagggtgaggccgaagtgaaacaggccgatctcgaggagtacaacggtgccctgctggcggacatgtacaccatctggggctacaccaaccccaagaagatcaat

SEQ ID NO: 222 - protein, 407 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPQASDNRNGEVQTASNAWLEVDLTAFEQNLQTLKTRPGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIDLRLTDSKQDALAMLKLKGITPVGIMTHFPVEEKEDVKLGLAQFKLDSQWLLEAGKLDRSKITIHAANSFATLAVPDAYFDMVRPGGLLYGDSIPSYTEYKRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIN

SEQ ID NO: 223 - DNA, 1221 bp, Unknown
  Obtained from environmental sample
atgcacaagaagacactgctagccaccttgatcctgggcctgctggccggtcaagccgtcgcagccccctatctgccgctggcaagcgatcatcgcaacggcgaagtacaaaccgccagcaacgcctggctggaagtagacctgaccgcgtttgaacagaatctgcagaccctcaagacccgcctcggcgacaagggcccgcagatctgcgccatcatgaaggccgacgcctacggtcacggcatcgatctgctggtcccctccgtggtcaaggcaggcattccctgcatcggcatcgccagcaatgaagaggcccgcgtggcccgcgagaagggcttcgagggccgcctgatgcgggtccgtgcagccaccccggccgaagtggaacaggccctgccctacaagctggaagagctggtgggcagcctggagagcgccaaggggatcgccgacatcgcccagcgccaccataccaccattccggtgcacataggtctgaactccgccggcatgagccgcaacggcatcgacctgcgccaggcggacgccaaggaagatgccctggccatggtcaagctcaaggggatcaccccggtcggcatcatgacccacttcccggtggaggagaaagaggacgtcaagctggggctggcccagttcaagctggactaccagtggctgatcgatgcgggcaagctggatcgcagcaagctcaccatacacgccgccaactccttcgccaccctggaagtgccggaagcctactttgacatggtacgcccgggcggcatcatctacggtgacaccatcccctcctacaccgaatacaagaaggtgatggcgttcaagacccaggtcgcctcggtgaaccactacccggcgggcaacaccgtcggctatgaccgcaccttcaccctcaagcgtgactccctgctcgccaacctgccgctgggttactccgacggctaccgccgtgcgctgagcaacaaggcctatgtgctgatccagggccagaaggtgcccgtggtgggcaagacctccatgaacaccatcatggtggacgtaaccgatctcaaaggggtgaaacccggtgatgaagtggtgctgttcggccgtcagggtgaggccgaggtgaagcaggcggatctggaggagtacaacggcgccctgctggcggacatgtacaccatctggggttacaccaaccccaagaagatcaaa

SEQ ID NO: 224 - protein, 407 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLTAFEQNLQTLKTRLGDKGPQICAIMKADAYGHGIDLLVPSVVKAGIPCIGIASNEEARVAREKGFEGRLMRVRAATPAEVEQALPYKLEELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIK

SEQ ID NO: 225 - DNA, 1227 bp, Unknown
  Obtained from environmental sample
atgcacaagaagacactgctcgccaccttgatcctgggcctgctggccggtcaagccgtcgcagccccctatctgccgcaggcgagcgataatcgcaacggcgaagtacaaaccgccagcaacgcctggctggaagtagacctgaccgcgtttgaacagaacctgcagactctcaagacccgcctcggcgacaagggcccgcagatctgcgccatcatgaaggcggatgcctacggtcacggcatcgatctgctggttccctccgtcatcaaggccgagatcccctgtatcggcatcgccagcaacgaagaggcccgcgtcgctcgcgagaagggctttaccggtcgcctgatgcgggtgcgcgccgccactcctgtcgaagtggaacaggccctgccctacaagctggaagagctggttggcagcctggtgagtgctcaggggatctccgacatcgccctgcgccacaatacccggatcccggtgcatattggcctcaactccgccggcatgagccgcaacggcatagacctgcgtctggccgattccaagcaagatgcgctggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggaggcctactttgacatggtgcgcccgggcggcatcatctacggtgacaccatcccctcctacaccgaatacaagaaggtgatggcgttcaagacccaggtcgcctcggtgaaccactacccggcgggcaacacagtcggctatgaccgcaccttcaccctcaagcgtgactccctgctcgccaacctgccgctcggttactccgacggctaccgccgtgcgctgagcaacaaggcctatgtgctgatccagggccagaaggtgcccgtggtgggcaagacctccatgaacaccatcatggtggacgtgaccgatctcaaaggggtgaaacccggtgatgaagtggtgctgttcggccgtcagggtgaggccgaggtgaagcaggcggatctggaggagtacaacggcgccctgctggcggacatgtacaccatctggggttacaccaaccccaagaagatcaatcgctga

SEQ ID NO: 226 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPQASDNRNGEVQTASNAWLEVDLTAFEQNLQTLKTRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIDLRLADSKQDALAMLKLKGITPVGIMTHFPVEEKEDVKLGLAQFKLDSQWLIEAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 227 - DNA, 1227 bp, Unknown
  Obtained from environmental sample
atgcacaagaagacactgcttgcgaccctggtcttcgggttgctcgccggccaggccgtcgccgccccctacctgccgctcgccagcgacacccgcaacggtcaggagcagaccgccgccaacgcctggctggaggtggacttgaccgccttcgagcacaacatccagaccctcaaggatcgtctcggcgacaagggcccgcagatctgcgccatcatgaaggccgacgcctacggtcacggcatcgatctgctggtcccctccgtggtcaaggcgggcattccctgcatcggcatcgccagcaatgaagaggcccgggtggcccgcgagaagggcttcgagggccgcctgatgcgggtccgtgccgccaccccggccgaagtggaacaggccctgccctacaagctggaagagctggtgggcagcctggagagcgccaaggggatcgccgacatcgcccagcgccaccataccaacattccggtacacataggtctgaactccgccggcatgagccgcaacggcatcgacctgcgccaggcaaacgccaaggaagatgccctggccatggtcaagctcaaggggatcaccccggtcggcatcatgacccacttcccggtggaagagaaagaggacgtcaagctggggctggcccagttcaagctggactaccagtggctcatcgacgcaggcaagctggatcgcagcaagctcaccatacacgccgccaactccttcgccaccctggaagtgccggaagcctactttgacatggtacgcccgggcggcatcatctacggtgacaccatcccctcctacaccgaatacaagaaggtgatggcgttcaagacccaggtcgcctcggtgaaccactacccggcgggcaacaccgtcggctatgaccgcaccttcaccctcaagcgtgactccctgctcgccaacctgccgctcggttactccgatggctaccgccgtgcgctgagcaacaaggcctatgtgctgatccagggccagaaggtgcccgtggtgggcaagacctccatgaacaccatcatggtggacgtgaccgacctcaaaggggtgaaacccggtgacgaagtggtgctgttcggccgtcagggtgaggccgaggtgaagcaggcggatctggaggagtacaacggcgccctgctggcggacatgtacaccatctggggttacaccaaccccagaagatcaatcgcctga

SEQ ID NO: 228 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCIGIASNEEARVAREKGFEGRLMRVRAATPAEVEQALPYKLEELVGSLESAKGIADIAQRHHTNIPVHIGLNSAGMSRNGIDLRQANAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPRRSIA

SEQ ID NO: 229 - DNA, 1227 bp, Unknown
  Obtained from environmental sample
atgcacaagaagacactgctagcgaccctggtcttcgggttactcgccggccaggccgtcgccgccccctatctgcccctggccagcgacacccgcaacggtcaggagcagaccgccgccaacgcctggctggaagtggatttgaccgccttcgagcacaacatccagaccctcaaggatcgtctcggcgacaagggcccgcagatctgcgccatcatgaaggccgacgcctacggtcacggcatcgatctgctggtcccctccgtggtcaaggcgggcattccctgcatcggcatcgccggcaatgaagaggcccgggtggcccgcgagaagggcttcgagggccgtctgatgcgggtccgcgccgctaccccggccgaagtggagcaggccctgccctacaagctggaagagctggtgggcagcctggagagcgccaaggggatcgccgacatcgcccagcgccaccataccaacattccggtgcacataggtctgaactccgccggcatgagccgcaacggcatcgacctgcgccaggcgggcgccaaggaagatgccctggccatggtcaagctccaggggatcaccccggtcggcatcatgacccacttcccggtggaagagaaagaggacgtcaagctggggctggcccagttcaagctggactaccagtggctgatcgaggcgggcaaactggatcgcagcaagctcaccattcacgccgccaactccttcgccaccctggaagtgccggaagcctactttgacatggtacgcccgggcggcatcatctacggcgacaccatcccctcctacaccgaatacaagaaggtgatggcgttcaagacccaggttgcctcggtgaaccactacccggcgggcaacacagtcggctatgaccgcaccttcaccctcaagcgcgactccctgctcgccaacctgccgctgggttactccgacggctaccgccgggcgctcagcagcaaggcctatgtgctgatccagggccagaaggtgcccgtggtgggcaagacctccatgaacaccatcatggtggacgtgaccgatctcaaaggggtgaaacccggtgacggggtggtgctgttcggccgtcagggtgaggccgaggtgaaacaggcggatctggaggagtacaacggcgccctgctggcggacatgtacaccatctggggctacaccaaccccaagaagatcaaccgctga

SEQ ID NO: 230 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCIGIAGNEEARVAREKGFEGRLMRVRAATPAEVEQALPYKLEELVGSLESAKGIADIAQRHHTNIPVHIGLNSAGMSRNGIDLRQAGAKEDALAMVKLQGITPVGIMTHFPVEEKEDVKLGLAQFKLDYQWLIEAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSSKAYVLIQGQKVPVVGKTSMNTIMVDVTDLKGVKPGDGVVLFGRQGEAEVKQADLEEYNGALLADMYTIWGYTNPKKINR

SEQ ID NO: 231 - DNA, 1227 bp, Unknown
  Obtained from environmental sample
atgcacaagaagacactgcttgccaccttgatcctgggcctgctggccggtcaagccgtcgcagccccctatctgccgcaggcgagcgatcatcgcaacggcgaagtacaaaccgccagcaacgcctggttggaagtggatctgggcgccttcgaacacaatatccagaccctcaaggatcgcctcggtgacaagggtccgcagatctgcgccatcatgaaggcggatgcctacggtcacggcatcgatctgctggttccctccgtcatcaaggccgagatcccctgtatcggcatcgccagcaacgaagaggcccgcgtcgctcgcgagaaggggtttaccggtcgcctgatgcgggtgcgcgccgccactcctgtcgaagtggaacaggccctgccctacaagctggaagagctggttggcagcctggtgagtgctcaggggatctcagacatcgccctgcgccacaatacccggatcccggtgcatattggcctcaactccgccggcatgagccgcaacggcatagacctgcgtctggccgattccaaacaagatgcgctgaccatgctcaagctcaaggggatcaccccggtcggcatcatgacccacttcccggtagaggagaaagaggacgtcaagatggggctggcccagttcaaactggactcccagtggctgctggaagcgggcaagctggatcgcagcaagatcaccatccacgccgccaactccttcgccaccctggaagtgccggatgcctacttcgacatggtgcgcccgggtggcctgctctacggcgactccatcccctcctacaccgaatacaagcgggtgatggcattcaagacccaggtcgcctcggtcaaccactacccggcaggcaactccgtcggctatgaccgcacctttaccctcaaacgtgactccctgctcgccaacctgccgctcggttactccgacggctatcgccgtgcgctcagcaacaaggcctatgtactgatccagggtcagaaggtacctgtggtgggcaagacctccatgaacaccatcatggtggacgtgaccgatctcaaaggggtgaaacccggtgatgaagtggtgctgtttggccgtcagggtgaggccgaagtgaaacaggccgatctcgaggagtacaacggtgccctgctggcggacatgtacaccatctggggctacaccaaccccaagaagatcaaccgctaa

SEQ ID NO: 232 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPQASDHRNGEVQTASNAWLEVDLGAFEHNIQTLKDRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIDLRLADSKQDALTMLKLKGITPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 233 - DNA, 1227 bp, Unknown
  Obtained from environmental sample
atgcacaagaagacactgctcgccaccttgatcctgggcctgctggccggtcaagccgtcgcagccccctatctgcctctggcaagcgatcatcgcaacggcgaagtacaaaccgccagcaacgcctggctggaagtagacctgaccgcgtttgaacagaatctgcagaccctcaagacccgcctcggcgacaagggcccgcagatctgcgccatcatgaaggcggacgcctacggtcacggcatcgacctgctggttttttccgtcatcaaggccgagatcccctgtatcggcatcgccagcaacgaagaggcccgcgtcgctcgcgagaaaggctttaccggccgcctgatgcgggtgcgcgccgccactcctgtcgaagtggaacaggccctgccctacaagctggaagagctggttggcagcctggtgagtgctcaggggatctccgatatcgccctgcgccacaatacccggatcccggtgcatattggcctcaattccgccggcatgagccgcaacggcatagacctgcgtctgaccgatgccaagcaggatgcgctggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggaggcctactttgacatggtgcgcccgggcggcctcatctacggcgactccatcccctcctacaccgaatacagacgggtgatggcattcaagacccaggtggcgtcggttaaccactatccggcaggcaactccgtcggctatgaccgcacctttaccctcaagcgtgactccctgctcgccaacctgccgctcggttactccgacggctatcgccgagcgctgagcaacaaggcctatgtactgatccagggtcagaaggtacctgtggtgggcaagacctccatgaacaccatcatggtggacgtgaccgatctcaaaggggtaaagcccggtgatgaagtggtgctgtttggccgtcagggtgaggccgaagtgaaacaggccgatctcgaggagtacaacggtgccctgctggcggacatgtacaccatctggggctacaccaaccccaagaagatcaaacgctaa

SEQ ID NO: 234 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLTAFEQNLQTLKTRLGDKGPQICAIMKADAYGHGIDLLVFSVIKAEIPCIGIASNEEARVAREKGFTGRLMRVRAATPVEVEQALPYKLEELVGSLVSAQGISDIALRHNTRIPVHIGLNSAGMSRNGIDLRLTDAKQDALAMLKLKGITPVGIMTHFPVEEKEDVKLGLAQFKLDSQWLIEAGKLDRSKLTIHAANSFATLEVPEAYFDMVRPGGLIYGDSIPSYTEYRRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 235 - DNA, 1221 bp, Unknown
  Obtained from environmental sample
atgcacaagaagacactgctagctaccctgatcttcggcctgctcgcgggccaagccgttgcggctccctatctgccccttgcgacggatcatcgcaacggccaggagcaaaccgccagcaacgcctggttggaagtggatctgggcgcctttgaacacaatatccagaccctcaaggatcgcctcggcgacaagggcccgcagatctgcgccatcatgaaggccgacgcttatggtcatggcatcgacctgctggtcccctccgtggtcaaggcaaatatcccctgcatcggcatcgccagcaacgaagaggcgcgcgtcgcccgcaagaagggctttaccggccgtctgatgcgggtgcgtgctgccaccccggatgaagtagagcaggccctgccctacaagatggaggagctgatcggcagtctggtcagtgcccagggtatcgccgatatcgcccagcgccaccacaccaccattccggtgcatattgcactcaactccgccggcatgagccgcaacggcatcgacctgcgtctggccgatgccaagcaggatgtgctggccatgctcaagctaaaggggatcaccccggtcggcatcatgacccacttcccggttgaggagaaagaggacgtcaagatgggactggcccagttcaaactggactcccagtggctgctggaagcgggcaaactggatcgcagcaagatcaccatccacgccgccaactccttcgccactctggccgtgccggacgcctacttcgacatggtgcgcccgggcggcctgctctacggtgactccatcccctcccacaccgaatacaagcgggtgatggcattcaagacccaggtcgcctcggtcaaccactatgcagcgggtaacaccgtcggttatgaccgcacctttactctcaagcgtgactcctggctcgccaacctgccgctgggctactccgatggctatcgccgcgccctcagcaacaaggcctatgtgctgatccagggtcagacggtgccggtggtcggcaagacttccatgaacaccatcatggtggatgtgactgatctgaaaggggtgaaacccggcgacgaggtggtgctgtttggccgtcagggtgacgccgaagtgaaacaggcggatctggaggagtacaacggcgccctgctggcggacatgtacaccatctggggctacaccaaccccaagaagatcaac

SEQ ID NO: 236 - protein, 407 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLIFGLLAGQAVAAPYLPLATDHRNGQEQTASNAWLEVDLGAFEHNIQTLKDRLGDKGPQICAIMKADAYGHGIDLLVPSVVKANIPCIGIASNEEARVARKKGFTGRLMRVRAATPDEVEQALPYKMEELIGSLVSAQGIADIAQRHHTTIPVHIALNSAGMSRNGIDLRLADAKQDVLAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHYAAGNTVGYDRTFTLKRDSWLANLPLGYSDGYRRALSNKAYVLIQGQTVPVVGKTSMNTIMVDVTDLKGVKPGDEVVLFGRQGDAEVKQADLEEYNGALLADMYTIWGYTNPKKIN

SEQ ID NO: 237 - DNA, 1227 bp, Unknown
  Obtained from environmental sample
atgcacaagaagacactgctcgccaccttgatcctgggcctgctggccggtcaagccgtcgcagccccctatctgccgcaggcgagcgatcatcgcaacggcgaagtacaaaccgccagcaacgcctggctggaagtagacctgaccgtgtttgaacagaacctgcagactctcaagacccgcctcggcgacaagggcccgcagatctgcgccatcatgaaggcggatgcctacggtcacggcatcgatctgctggttccctccgtggtcaaggccaatatcccctgtatcggcatcgccagcaacgaagaggcccgcgtcgctcgcgagaaaggctttaccggccgcctgatgcgggtgcgcgccgccactcctgtcgaagtggaacaggccctgccctacaagctggaggagctgatcggcagtctggtcagtgcccagggtatcgccgatatcgcccagcgccaccacaccaccattccggtgcatattgcactcaactccgccggcatgagccgcaacggcatcgacctgcgtctggccgatgccaagcaggatgtgctggccatgctcaagctaaaggggatcaccccggtcggcatcatgacccacttcccggttgaggagaaagaggacgtcaagatgggactggcccagttcaaactggactcccagtggctgctggaagcgggcaaactggatcgcagcaagatcaccatccacgccgccaactccttcgccactctggccgtgccggacgcctacttcgacatggtgcgcccgggcggcctgctctacggtgactccatcccctcccacaccgaatacaagcgggtgatggcattcaagacccaggtcgcctcggtcaaccactatgcagcgggtaacaccgtcggttatgaccgcacctttactctcaagcgtgactcctggctcgccaacctgccgctgggctactccgatggctatcgccgcgccctcagcaacaaggcctatgtgctgatccagggtcagacggtgccggtggtcggcaagacttccatgaacaccatcatggtggatgtgactgatctgaaaggggtgaaacccggcgacgaggtggtgctgtttggccgtcagggtgacgccgaagtgaaacaggcggatctggaggagtacaacggcgccctgctggcggacatgtacaccatctggggctacaccaaccccaagaagatcaaacgctga

SEQ ID NO: 238 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPQASDHRNGEVQTASNAWLEVDLTVFEQNLQTLKTRLGDKGPQICAIMKADAYGHGIDLLVPSVVKANIPCIGIASNEEARVAREKGFTGRLMRVRAATPVEVEQALPYKLEELIGSLVSAQGIADIAQRHHTTIPVHIALNSAGMSRNGIDLRLADAKQDVLAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHYAAGNTVGYDRTFTLKRDSWLANLPLGYSDGYRRALSNKAYVLIQGQTVPVVGKTSMNTIMVDVTDLKGVKPGDEVVLFGRQGDAEVKQADLEEYNGALLADMYTIWGYTNPKKIKR

SEQ ID NO: 239 - DNA, 1221 bp, Unknown
  Obtained from environmental sample
atgcacaagaagacactgctggccaccttgatcctgggcctgctggccggtcaagccgtcgcagccccctatctgccgcaggcgaacgatcatcgcaacggcgaagtacaaaccgccagcaacgcctggctggaagtagacctgaccgcgtttgaacagaacctgcagaccctcaagacccgcctcggcgacaagggcccgcagatctgcgccatcatgaaggcggacgcctacggtcacggtatcgatctgctggttccctccgtcatcaaggccgagatcccctctatcggcatcgccagcaacgaagaggcccgcgtcgctcgcgagaagggctttaccggtcgcctgatgcgggtgcgcgccgccactcctgtcgaagtggaacaggccctgccctacaagctggaagagctggttggcagcctggtgagtgctcaggggatctccgatatcgccctgcgccacaatacccggatcccggtgcatattggcctcaattccgccggcatgagccgcaacggcatagacctgcgtctgaccgatgccaagcaagatgcgctggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggaggcctactttgacatggtgcgcccgggcggcctcatctacggcgactccatcccctcctacaccgaatacagacgggtgatggcattcaagacccaggtggcgtcggttaaccactatccggcaggcaactccgtcggctatgaccgcacctttaccctcaaacgtgactccctgctcgccaacctgccgctcggttactccgacggctatcgccgtgcgctcagcaacaaggcctatgtactgatccagggtcagaaggtacctgtggtgggcaagacctccatgaacaccatcatggtggacgtgaccgatctcaaaggggtgaaacccggtgatgaagtggtgctgtttggccgtcagggtgaggccgaagtgaaacaggccgatctggaggagtacaacggtgccctgctggcggacatgtacaccatctggggctacaccaaccccaagaagatcaat

SEQ ID NO: 240 - protein, 407 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPQANDHRNGEVQTASNAWLEVDLTAFEQNLQTLKTRLGDKGPQICAIMKADAYGHGIDLLVPSVIKAEIPSIGIASNEEARVAREKGFTGRLMRVRAATPVEVEQALPYKLEELVGSLVSAQGISDIALRHNTRIPVHIGLNSAGMSRNGIDLRLTDAKQDALAMLKLKGITPVGIMTHFPVEEKEDVKLGLAQFKLDSQWLIEAGKLDRSKLTIHAANSFATLEVPEAYFDMVRPGGLIYGDSIPSYTEYRRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIN

SEQ ID NO: 241 - DNA, 1227 bp, Unknown
  Obtained from environmental sample
atgcacaagaagacactgctagccaccttgatcctgggcctgctggccggtcaagccgtcgcagccccctatctgcctctggcaagcgatcatcgcaacggcgaagtacaaaccgccagcaacgcctggctggaagtagacctgaccgcgtttgaacagaatctgcagaccctcaagacccgcctcggcgacaagggcccgcagatctgcgccatcatgaaggcggacgcctacggtcacggcatcgacctgctggttccctccgtcatcaaggccgagatcccctgtatcggcatcgccagcaacgaagaggcccgcgtcgctcgcgagaaaggctttaccggccgcctgatgcgggtgcgcgccgccactcctgtcgaagtggaacgggccctgccctacaagctggaagagctggttggcagcctggtgagtgctcaggggatctccgatatcgccctgcgccacaatacccggatcccggtgcatattggcctcaattccgccggcatgagccgcaacggcatagacctgcgtctgaccgatgccaagcaagatgcgctggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggaggcctactttgacatggtgcgcccgggcggcctcatctacggcgactccatcccctcctacaccgaatacagacgggtgatggcattcaagacccaggtggcgtcggttaaccactatccggcaggcaactccgtcggctatgaccgcacctttaccctcaaacgtgactccctgctcgccaacctgccgctcggttactccgacggctatcgccgtgcgctcagcaacaaggcctatgtactgatccagggtcagaaggtacctgtggtgggcaagacctccatgaacaccatcatggtggacgtgaccgatctcaaaggggtgaaacccggtgatgaagtggtgctgtttggccgtcagggtgaggccgaagtgaaacaggccgatctggaggagtacaacggtgccctgctggcggacatgtacaccatctggggctacaccaaccccaagaagatcaaacgctga

SEQ ID NO: 242 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLTAFEQNLQTLKTRLGDKGPQICAIMKADAYGHGIDLLVPSVIKAEIPCIGIASNEEARVAREKGFTGRLMRVRAATPVEVERALPYKLEELVGSLVSAQGISDIALRHNTRIPVHIGLNSAGMSRNGIDLRLTDAKQDALAMLKLKGITPVGIMTHFPVEEKEDVKLGLAQFKLDSQWLIEAGKLDRSKLTIHAANSFATLEVPEAYFDMVRPGGLIYGDSIPSYTEYRRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 243 - DNA, 1227 bp, Unknown
  Obtained from environmental sample
atgcacaagaagacactgcttgctaccctgatcttcggcctgctcgcgggccaagccgttgcggctccctatctgccccttgcgacggatcatcgcagcggccaggagcaaaccgccagcaacgcttggttggaagtggatctgggcgcctttgaacacaatatccagaccctcaaggatcgtctcggtgacaagggcccgcagatctgcgccatcatgaaggccgacgcttatggtcatggcatcgacctgctggtcccctccgtggtcaaggccaatatcccctgcatcggcatcgccagcaacgaagaggcgcgcgtcgcccgcgagaagggctttactggccgtctgatgcgggtgcgtgctgccaccccggacgaagtagagcaggccctgccctacaagatggaggagctgatcggcagtctggtgagtgcccaaggtatcgccgagatcgcccagcgccaccacaccaccattccggtgcatattgcgctcaactccgccggcatgagccgcaacggcatcgacctgcgtctggccgatgccaagcaggatgcgctggccatgctcaagctaaaggggatcaccccggtcggcatcatgacccacttcccggttgaggagaaagaggacgtcaagatgggactggcccagttcaaactggactcccagtggctgctggaagcgggcaagctggatcgcagcaagatcaccatccacgccgccaactccttcgccaccctggccgtgccggacgcctacttcgacatggtgcgcccgggcggcctgctctacggtgactccatcccctcccacaccgaatacaagcgggtgatggcattcaagacccaggtcgcctcggtcaaccactttgcagcgggcaacaccgtcggttatgaccgcacctttaccctcaagcgtgactcctggctcgccaacctgccgctcggttactccgacggttatcgccgctccctgagcaacaaggcctatgtgctgatcaagggtcagaaggtgccggtggtcggcaagacctccatgaacaccatcatggtggacgtgaccgatctgaaaggggtcaaacccggtgacgaggtggtgctgtttggccgtcagggaagtgccgaggtgaaacaggcggatctggaggagtacaacggcgccctgctggcggacatgtacaccatctggggctacaccaaccccaagaagatcaatcgctga

SEQ ID NO: 244 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLIFGLLAGQAVAAPYLPLATDHRSGQEQTASNAWLEVDLGAFEHNIQTLKDRLGDKGPQICAIMKADAYGHGIDLLVPSVVKANIPCIGIASNEEARVAREKGFTGRLMRVRAATPDEVEQALPYKMEELIGSLVSAQGIAEIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHFAAGNTVGYDRTFTLKRDSWLANLPLGYSDGYRRSLSNKAYVLIKGQKVPVVGKTSMNTIMVDVTDLKGVKPGDEVVLFGRQGSAEVKQADLEEYNGALLADMYTIWGYTNPKKINR

SEQ ID NO: 245 - DNA, 1227 bp, Unknown
  Obtained from environmental sample
atgcacaagaagacactgctagctaccctgatcttcggcctgctcgcgggccaagccgttgcggctccctatctgccccttgcgacggatcatcgcaacggccaggagcaaaccgccagcaacgcctggttggaagtggatctgggcgcctttgaacacaatatccagaccctcaaggatcgcctcggcgagaagggcccgcagatctgcgccatcatgaaggccgacgcttacggtcatggcatcgacctgctggtcccctccgtggtcaaggccaatatcccctgcatcggcatcgccagcaacgaagaggcccgcgtcgcccgcgagaagggctttactggccgtctgatgcgggtgcgtgctgccaccccggacgaagtagagcaggccctgccctacaagatggaggagctgatcggcagtctggtcagtgcccagggtatcgccgatatcgcccagcgccaccacaccaccattccggtgcatattgcactcaactccgccggcatgagccgcaacggcatcgacctgcgtctggccgatgccaagcaggatgcgctggccatgctcaagctaaaggggatcaccccggtcggcatcatgacccacttcccggttgaggagaaagaggacgtcaagatggggctggcccagttcaaactggactcccagtggctgctggaagcgggcaagctggatcgcagcaagatcaccatccacgccgccaactccttcgccaccctggccgtgccggacgcctacttcgacatggtgcgcccgggtggcctgctctacggcgactccatcccctcccataccgagtacaagcgggtgatggcattcaagacccaggtcgcctcggtcaaccactttgcagcgggcaacaccgtcggttatgaccgcacctttaccctcaagcgtgactcctggctcgccaacctgccgctcggttactccgacggttatcgccgctccctgagcaacaaggcctatgtgctgatcaagggtcagaaggtgccggtggtcggcaagacctccatgaacaccatcatggtggacgtgaccgatctgaaaggggtcaaacccggtgacgaggtggtgctgtttggccgtcagggaagtgccgaggtgaaacaggcggatctggaggagtacaacggcgccctgctggcggacatgtacaccatctggggctacaccaaccccaagaagatcaaccgctga

SEQ ID NO: 246 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLIFGLLAGQAVAAPYLPLATDHRNGQEQTASNAWLEVDLGAFEHNIQTLKDRLGEKGPQICAIMKADAYGHGIDLLVPSVVKANIPCIGIASNEEARVAREKGFTGRLMRVRAATPDEVEQALPYKMEELIGSLVSAQGIADIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHFAAGNTVGYDRTFTLKRDSWLANLPLGYSDGYRRSLSNKAYVLIKGQKVPVVGKTSMNTIMVDVTDLKGVKPGDEVVLFGRQGSAEVKQADLEEYNGALLADMYTIWGYTNPKKINR

SEQ ID NO: 247 - DNA, 1227 bp, Unknown
  Obtained from environmental sample
atgcacaagaagacactgctagctaccctgatcttcggcctgctcgcgggccaagccgttgcggctccctatctgccccttgcgacggatcatcgcaacggccaggagcaaaccgccagcaacgcctggttggaagtggatctgggcgcctttgaacacaatatccagaccctcaaggatcgcctcggcgacaagggcccgcagatctgcgccatcatgaaggccgacgcttacggtcatggcatcgacctgctggtcccctccgtggtcaaggcaaatatcccctgcatcggcatcgccagcaacgaagaggcgcgcgtcgcccgcgagaagggctttaccggccgtctgatgcgggtgcgtgctgccaccccggatgaagtagagcaggccctgccctacaagatggaggagctgatcggcagtctggtcagtgcccagggtatcgccgatatcgcccagcgccaccacaccaccattccggtgcatattgcactcaactccgccggcatgagccgcaacggcatcgacctgcgtctggccgatgccaagcaggatgcgctggccatgctcaagctaaaggggatcaccccggtcggcatcatgacccacttcccggttgaggagaaagaggacgtcaagatgggactggcccagttcaaactggactcccagtggctgctggaagcgggcaagctggatcgcagcaagatcaccatccacgccgccaactccttcgccactctggccgtgccggacgcctacttcgacatggtgcgcccgggcggcctgctctacggtgactccatcccctcccacaccgaatacaagcgggtgatggcattcaagacccaggtcgcctcggtcaaccactatgcagcgggtaacaccgtcggttatgaccgtacctttaccctcaaacgtgactcctggctcgccaacctgccgctgggctactccgatggctatcgccgcgccctcagcaacaaagcctatgtgctgatccagggtcagaaggtaccggtggtcggcaagacctccatgaacaccatcatggtggacgtgaccgacctgaagggtgtgaaacccggtgacgaggtggtgctgtttggccgccagggtgacgccgaagtgaaacaggcggatctggaggagtacaacggcgccctgctggcggacatgtacaccatctggggctacaccaaccccaagaagatcaaacgctga

SEQ ID NO: 248 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLIFGLLAGQAVAAPYLPLATDHRNGQEQTASNAWLEVDLGAFEHNIQTLKDRLGDKGPQICAIMKADAYGHGIDLLVPSVVKANIPCIGIASNEEARVAREKGFTGRLMRVRAATPDEVEQALPYKMEELIGSLVSAQGIADIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHYAAGNTVGYDRTFTLKRDSWLANLPLGYSDGYRRALSNKAYVLIQGQKVPVVGKTSMNTIMVDVTDLKGVKPGDEVVLFGRQGDAEVKQADLEEYNGALLADMYTIWGYTNPKKIKR

SEQ ID NO: 249 - DNA, 1227 bp, Unknown
  Obtained from environmental sample
atgcacaagaagacactgcttgctaccctgatcttcggcctgctcgcgggccaagccgttgcggctccctatctgccccttgcgacggatcatcgcaacggccaggagcaaaccgccagcaacgcctggttggaagtggatctgggcgcctttgaacacaatatccagaccctcaaggatcgcctcggcgacaagggcccgcagatctgcgccatcatgaaggccgacgcttacggtcatggcatcgacctgctggtcccctccgtggtcaaggcaaatatcccctgcatcggcatcgccagcaacgaagaggcgcgcgtcgcccgcgagaagggctttaccggccgtctgatgcgggtgcgtgctgccaccccggatgaagtagagcgggccctgccctacaagatggaggagctgatcggcagtctggtcagtgcccagggtatcgccgatatcgcccagcgccaccacaccaccattccggtgcatattgcactcaactccgccggcatgagccgcaacggcatcgacctgcgtctggccgatgccaagcaggatgcgctggctatgctcaagctcaaggggatcaccccggtcggcatcatgacccacttcccggttgaggagaaagaggacgtcaagatggggctggcccagttcaaactggactcccagtggctgctggaagcgggcaagctggatcgcagcaagatcaccatccacgccgccaactccttcgccaccctggccgtgccggacgcctacttcgacatggtgcgcccgggtggcctgctctacggcgactccatcccctcccataccgagtacaagcgggtgatggcattcaagacccaggtcgcctcggtcaaccactttgcagcgggcaacaccgtcggttatgaccgcacctttaccctcaagcgtgactcctggctcgccaacctgccgctcggttactccgacggttatcgccgctccctgagcaacaaggcctatgtgctgatcaagggtcagaaggtgccggtggtcggcaagacctccatgaacaccatcatggtggacgtgaccgatctgaaaggggtcaaacccggtgacgaggtggtgctgtttggccgtcagggtgacgccgaagtgaaacaggcggatctggaggagtacaacggcgccctgctggcggacatgtacaccatctggggctacaccaaccccaagaagatcaatcgctga

SEQ ID NO: 250 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLIFGLLAGQAVAAPYLPLATDHRNGQEQTASNAWLEVDLGAFEHNIQTLKDRLGDKGPQICAIMKADAYGHGIDLLVPSVVKANIPCIGIASNEEARVAREKGFTGRLMRVRAATPDEVERALPYKMEELIGSLVSAQGIADIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHFAAGNTVGYDRTFTLKRDSWLANLPLGYSDGYRRSLSNKAYVLIKGQKVPVVGKTSMNTIMVDVTDLKGVKPGDEVVLFGRQGDAEVKQADLEEYNGALLADMYTIWGYTNPKKINR

SEQ ID NO: 251 - DNA, 1227 bp, Unknown
  Obtained from environmental sample
atgcacaagaagacactgctagctaccctgatcttcggcctgctcgcgggccaagccgttgcggctccctatctgccccttgcgacggatcatcgcaacggccaggagcaaaccgccagcaacgcctggttggaagtggatctgggcgcctttgaacacaatatccagaccctcaaggatcgcctcggcgagaagggcccgcagatctgcgccatcatgaaggccgacgcttacggtcatggcatcgacctgctggtcccctccgtggtcaaggccaatatcccctgcatcggcatcgccagcaacgaagaggcccgcgtcgcccgcgagaagggctttactggccgtctgatgcgggtgcgtgctgccaccccggacgaagtagagcgggccctgccctacaagatggaggagctgatcggcagtctggtgagtgcccagggtatcgccgagatcgcccagcgccaccacaccaccattccggtgcatattgcgctcaactccgccggcatgagccgcaacggcatcgacctgcgtctggccgatgccaagcaggatgcgctggctatgctcaagctcaaggggattaccccggtcggcatcatgacccacttcccggttgaggagaaagaggacgtcaagatggggctggcccagttcaaactggactcccagtggctgctggaagcgggcaagctggatcgcagcaagatcaccatccacgccgccaactccttcgccactctggccgtgccggacgcctacttcgacatggtgcgcccgggcggcctgctctacggtgactccatcccctcccacaccgaatacaagcgggtgatggcattcaagacccaggtcgcctcggtcaaccactatgcagcgggtaacaccgtcggttatgaccgtacctttaccctcaaacgtgactcctggctcgccaacctgccgctgggctactccgatggctatcgccgcgccctcagcaacaaagcctatgtgctgatccagggtcagaaggtaccggtggtcggcaagacctccatgaacaccatcatggtggacgtgaccgacctgaagggtgtgaaacccggtgacgaggtggtgctgtttggccgtcagggtgacgccgaagtgaaacaggcggatctggaggagtacaacggcgccctgctggcggacatgtacaccatctggggctacaccaaccccaagaagatcaatcgctga

SEQ ID NO: 252 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLIFGLLAGQAVAAPYLPLATDHRNGQEQTASNAWLEVDLGAFEHNIQTLKDRLGEKGPQICAIMKADAYGHGIDLLVPSVVKANIPCIGIASNEEARVAREKGFTGRLMRVRAATPDEVERALPYKMEELIGSLVSAQGIAEIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHYAAGNTVGYDRTFTLKRDSWLANLPLGYSDGYRRALSNKAYVLIQGQKVPVVGKTSMNTIMVDVTDLKGVKPGDEVVLFGRQGDAEVKQADLEEYNGALLADMYTIWGYTNPKKINR

SEQ ID NO: 253 - DNA, 1221 bp, Unknown
  Obtained from environmental sample
atgcacaagaagacactgctggctaccctgatcttcggcctgctcgcgggccaagccgttgcggctccctatctgccccttgcgacggatcatcgcaacggccaggagcaaaccgccagcaacgcctggttggaagtggatctgggcgcctttgaacacaatatccagaccctcaaggatcgcctcggcgagaagggcccgcagatctgcgccatcatgaaggccgacgcttacggtcatggcatcgacctgctggtcccctccgtggtcaaggccaatatcccctgcatcggcatcgccagcaacgaagaggcccgcgtcgcccgcgagaagggctttactggccgtctgatgcgggtgcgtgctgccaccccggacgaagtagagcaggccctgccctacaagatggaggagctgatcggcagtctggtgagtgcccagggtatcgccgagatcgcccagcgccaccacaccaccattccggtgcatattgcgctcaactccgccggcatgagccgcaacggcatcgacctgcgtctggccgatgccaagcaggatgcgctggctatgctcaagctcaaggggatcaccccggtcggcatcatgacccacttcccggttgaggagaaagaggacgtcaagatggggctggcccagttcaaactggactcccagtggctgctggaagcgggcaagctggatcgcagcaagatcaccatccacgccgccaactccttcgccaccctggccgtgccggacgcctacttcgacatggtgcgcccgggtggcctgctctacggcgactccatcccctcccataccgagtacaagcgggtgatggcattcaagacccaggtcgcctcggtcaaccactttgcagcgggcaacaccgtcggttatgaccgcacctttaccctcaagcgtgactcctggctcgccaacctgccgctcggttactccgacggttatcgccgctccctgagcaacaaggcctatgtgctgatcaagggtcagaaggtgccggtggtcggcaagacctccatgaacaccatcatggtggacgtgaccgatctgaaaggggtcaaacccggtgacgaggtggtgctgtttggccgtcagggaagtgccgaggtgaaacaggcggatctggaggagtacaacggcgccctgctggcggacatgtacaccatctggggctacaccaaccccaagaagatcaac

SEQ ID NO: 254 - protein, 407 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLIFGLLAGQAVAAPYLPLATDHRNGQEQTASNAWLEVDLGAFEHNIQTLKDRLGEKGPQICAIMKADAYGHGIDLLVPSVVKANIPCIGIASNEEARVAREKGFTGRLMRVRAATPDEVEQALPYKMEELIGSLVSAQGIAEIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHFAAGNTVGYDRTFTLKRDSWLANLPLGYSDGYRRSLSNKAYVLIKGQKVPVVGKTSMNTIMVDVTDLKGVKPGDEVVLFGRQGSAEVKQADLEEYNGALLADMYTIWGYTNPKKIN

SEQ ID NO: 255 - DNA, 1083 bp, Unknown
  Obtained from environmental sample
atgtcgggaccgcaagtcaccgtcgacctcgaccgcatcgagcgcaacgcccgtgccgtcgtctcgcgctgcgcgcaatccggcatcaaggtgttcggggtcaccaagggaacctgcggcatgccacaggtggcgcgcgccatgctgcgcggcggcgtcgtcgggatcgccgagtcccggttcgagaacatccgccgcttgcgcgagagcggaatcgccgccccggtcatgctgctgcgcagcccgccgctgtcccgcgtcgaggaggttgtgcgcacggtcgacatcagcctgcagtcggaactcgccattatcgcagagctgtcgcgcatcgccgagcggatggggcgcgtgcacgacatcatcctgatgatcgacctcggcgacctgcgcgaaggaatctggccgagcgatctcttgtccaccgtcgagcagatcctcggattgaagggggtgcgcatcgccggcgtgggcaccaatctcggctgcttcggcgctatcatgccgacggaggaaaatctgggccagctggttgcgcatgcctacaagatcgaacgcctcacgggccggcagctcgacttcatttcgggtggcgcgtcgtcgacgctgccgctgctgctcgacgaaacgttgcctgccggaatcaacaatctgcgcgtcggcgaggccattctgcagggcggtctcgagaccttccgcgacaagccgtgggaggcgctcgagctggacgcgtgcacgctcaccagcgacatcatcgaagtgaagttgaaaccgtcgcggccgatcggccgatccggctatgacgccttcggcaaccagccggtattcgtcgacgaaggcgaccggttgcgggcgatcgccaatcttggccgcgaggacgttctcatcgaagggctgacgccgctcaccaggggcgtgcgcgtgctcggtggatcgagcgatcatctgctgatggacgtcaccgacgcggagccgcctgtcgcggtgggcgatcgcatggcctttcgaatgaactacggcgcaatgctggcggcgatgacgtcggagtatgtcgagaagacaccgatgcacgacgtgcaggtc

SEQ ID NO: 256 - protein, 361 aa, Unknown
  Obtained from environmental sample
  DOMAIN (3)...(230): Alanine racemase, N-terminal domain
MSGPQVTVDLDRIERNARAVVSRCAQSGIKVFGVTKGTCGMPQVARAMLRGGVVGIAESRFENIRRLRESGIAAPVMLLRSPPLSRVEEVVRTVDISLQSELAIIAELSRIAERMGRVHDIILMIDLGDLREGIWPSDLLSTVEQILGLKGVRIAGVGTNLGCFGAIMPTEENLGQLVAHAYKIERLTGRQLDFISGGASSTLPLLLDETLPAGINNLRVGEAILQGGLETFRDKPWEALELDACTLTSDIIEVKLKPSRPIGRSGYDAFGNQPVFVDEGDRLRAIANLGREDVLIEGLTPLTRGVRVLGGSSDHLLMDVTDAEPPVAVGDRMAFRMNYGAMLAAMTSEYVEKTPMHDVQV

SEQ ID NO: 257 - DNA, 1227 bp, Unknown
  Obtained from environmental sample
atgcacaagaagacactgcttgccaccttgatcctgggcctgctggccggtcaagccgtcgcagccccctatctgccgcaggcgagcgataatcgcaacggcgaagtacaaaccgccagcaacgcctggctggaagtagacctgaccgcgtttgaacagaacctgcagactctcaagacccgcctcggcgacaagggcccgcagatctgcgccatcatgaaggcggatgcctacggtcacggcatcgatctgctggttccctccgtcatcaaggccgagatcccctgtatcggcatcgccagcaacgaagaggcccgcgtcgctcgcgagaagggctttaccggtcgcctgatgcgggtgcgcgccgccactcctgttgaagtggaacaggccctgccctacaagctggaagagctggttggcagcctggtgagtgctcaggggatctccgacatcgccctgcgccacaatacccggatcccggtgcatattggcctcaattccgccggcatgagtcgcaacggcatagacctgcgtctgaccgattccaagcaagatgcgctggccatgctcaaactcaaggggatcaccccggtcggcatcatgacccacttcccggtggaggaaaaagaggacgtcaagctggggctggcccagttcaagctggactcccagtggctgatcgaggcgggcaagctggatcgcagcaagctcaccatccacgcggccaactccttcgccaccctggcagtgccggaggcctactttgacatggtgcgcccgggcggcctcatctacggcgactccatcccctcttacaccgaatacaaacgggtgatggcattcaagacccaggtggcgtcggtcaaccactatccggcaggcaactccgtcggctatgaccgcacctttaccctcaagcgtgactccctgctcgccaacctgccgctcggttactccgacggctatcgccgtgcgctgagcaacaaggcctatgtactgatccagggtcagaaggttcctgtggtgggcaaaacctctatgaacaccatcatggtggacgtgaccgacctcaaaggggtgaaacccggtgatgaagtggtgctgtttggccgtcagggtgaggccgaagtgaaacaggccgatctcgaggagtacaacggtgccctgctggcggacatgtacaccatctggggctacaccaaccccaagaagatcaaacgctaa

SEQ ID NO: 258 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPQASDNRNGEVQTASNAWLEVDLTAFEQNLQTLKTRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIDLRLTDSKQDALAMLKLKGITPVGIMTHFPVEEKEDVKLGLAQFKLDSQWLIEAGKLDRSKLTIHAANSFATLAVPEAYFDMVRPGGLIYGDSIPSYTEYKRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 259 - DNA, 1227 bp, Unknown
  Obtained from environmental sample
atgcacaagaagacactgctagccaccttgatcctgggcctgctggccggtcaagccgtcgcaaccccctatctgccgcaggcgagcgatcatcgcaacggcgaagtacaaaccgccagcaacgcctggctggaagtagacctgaccgcgtttgaacagaacctgcagactctcaagacccgcctcggagacaagggcccgcagatctgcgccatcatgaaggcggatgcctacggtcacggcatcgatctgctggttccctccgtcatcaaggccgagatcccctgtatcggcatcgccagcaacgaagaggcccgcgtcgctcgcgagaaaggctttaccggtcgcctgatgcgggtgcgcgccgccactcctgtcgaagtggaacaggccctgccctacaagctggaagagctggttggcagcctggtgagtgctcaggggatctccgacatcgccctgcgccacaatacccggatcccggtgcatattggcctcaactccgccggcatgagccgcaacggcatagacctgcgtctggccgattccaagcaagatgcgctggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggacgcctactttgacatggtgcgcccgggcggcctgctctacggcgactccatcccctcctacaccgaatacaaacgggtgatggcattcaagacccaggtggcgtcggttaaccactatccggcaggcaactccgtcggctatgaccgcacctttaccctcaagcgtgactccctgctcgccaacctgccgctcggttactccgacggctatcgccgtgcgctgagcaacaaggcctatgtactgatccagggtcagaaggtacctgtggtgggcaaaacctccatgaacaccatcatggtggacgtgaccgacctcaaaggggtgaaacccggtgatgaagtggtgctgtttggccatcagggtgaggccgaagtgaaacaggccgatctcgaggagtacaacggtgccctgctggcggacatgtacaccatctggggctacaccaaccccaagaagatcaaccgctga

SEQ ID NO: 260 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVATPYLPQASDHRNGEVQTASNAWLEVDLTAFEQNLQTLKTRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIDLRLADSKQDALAMLKLKGITPVGIMTHFPVEEKEDVKLGLAQFKLDSQWLIEAGKLDRSKLTIHAANSFATLEVPDAYFDMVRPGGLLYGDSIPSYTEYKRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGHQGEAEVKQADLEEYNGALLADMYTIWGYTNPKKINR

SEQ ID NO: 261 - DNA, 1227 bp, Unknown
  Obtained from environmental sample
atgcacaagaagacactgctagccaccttgatcctgggcctgctggccggtcaagccgtcgcagccccctatctgccgcaggcgagcgatcatcgcaacggcgaagtacaaaccgccagcaacgcctggctggaagtagacctgaccgcgtttgaacagaacctgcagactctcaagacccgcctcggagacaagggcccgcagatctgcgccatcatgaaggcggatgcctacggtcacggcatcgatctgctggttccctccgtcatcaaggccgagatcccctgtatcggcatcgccagcaacgaagaggcccgcgtcgctcgcgagaagggctttaccggtcgcctgatgcgggtgcgcgccgccactcctgtcgaagtggaacaggccctgccctacaagctggaagagctggttggcagcctggtgagtgctcaggggatctccgacatcgccctgcgccacaatacccggatcccggtgcatattggcctcaactccaccggcatgagccgcaacggcatagacctgcgtctggccgattccaagcaagatgcgctggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcaacaagctcaccatccacgcggccaactccttcgccaccctggaagtgccggacgcctactttgacatggtgcgcccgggcggcctgctctacggcgactccatcccctcctacaccgaatacaaacgggtgatggcattcaagacccaggtggcgtcggttaaccactatccggcaggcaactccgtcggctatgaccgcacctttaccctcaagcgtgactccctgctcgccaacctgccgctcggttactccgacggctatcgccgtgcgctgagcaacaaggcctatgtactgatccagggtcagaaggtacctgtggtgggcaagacctccatgaacaccatcatggtggacgtgaccgacctcaaagaggtgaaacccggtgatgaagtggtgctgtttggccgtcagggtgaggccgaagtgaaacaggccgatctcgaggagtacaacggtgccctgctggcggacatgtacaccatctggggctacaccaaccccaagaagatcaatcgctaa

SEQ ID NO: 262 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
  SITE (169)...(172): N-glycosylation site. Prosite id = PS00001
MHKKTLLATLILGLLAGQAVAAPYLPQASDHRNGEVQTASNAWLEVDLTAFEQNLQTLKTRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSTGMSRNGIDLRLADSKQDALAMLKLKGITPVGIMTHFPVEEKEDVKLGLAQFKLDSQWLIEAGKLDRNKLTIHAANSFATLEVPDAYFDMVRPGGLLYGDSIPSYTEYKRVMAFKTQVASVNHYPAGNSVGYDRTFTLKRDSLLANLPLGYSDGYRRALSNKAYVLIQGQKVPVVGKTSMNTIMVDVTDLKEVKPGDEVVLFGRQGEAEVKQADLEEYNGALLADMYTIWGYTNPKKINR

SEQ ID NO: 263 - DNA, 1227 bp, Unknown
  Obtained from environmental sample
atgcacaagaagacactgctagccaccttgatcctgggcctgctggccggtcaagccgtcgcagccccctatctgccgcaggcgagcgatcatcgcaacggcgaagtacaaaccgccagcaacgcctggctggaagtagacctgaccgcgtttgaacagaacctgcagactctcaagacccgcctcggagacaagggcccgcagatctgcgccatcatgaaggcggatgcctacggtcacggcatcgatctgctggttccctccgtcatcaaggccgagatcccctgtattggcatcgccagcaacgaagaggcccgcgtcgctcgcgagaaaggctttaccggtcgcctgatgcgggtgcgcgccgccactcctgtcgaagtggaacaggccctgccctacaagctggaagagctggttggcagcctggtgagtgctcaggggatctccgacatcgccctgcgccacaatacccggatcccggtgcatattggcctcaactccgccggcatgagccgcaacggcatagacctgcgtctggccgattccaagcaagatgcgctggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggacgcctactttgacatggtgcgcccgggcggcctgctctacggcgactccatcctttcctacaccgaatacaaacgggtgatggcattcaagacccaggtggcgtcggttaaccactatccggcaggcaactccgtcggctatgaccgcacctttaccctcaagcgtgactccctgctcgccaacctgccgctcggttactccgacggctatcgccgtgcgctgagcaacaaggcctatgtactgatccagggtcagaaggtacctgtggtgggcaagacctccatgaacaccatcatggtggacgtgaccgacctcaaaggggtgaaacccggtgatgaagtggtgctgtttggccgtcagggtgaggccgaagtgaaacaggccgatctcgaggagtacaacggtgccctgctggcggacatgtacaccatctggggctacaccaaccccaagaagatcaaccgctaa

SEQ ID NO: 264 - protein, 408 aa, Unknown
  Obtained from environmental sample
  SIGNAL (1)...(21)
  DOMAIN (41)...(271): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPQASDHRNGEVQTASNAWLEVDLTAFEQNLQTLKTRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIDLRLADSKQDALAMLKLKGITPVGIMTHFPVEEKEDVKLGLAQFKLDSQWLIEAGKLDRSKLTIHAANSFATLEVPDAYFDMVRPGGLLYGDSILSYTEYKRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 265 - DNA, 1227 bp, Unknown
  Obtained from environmental sample
atgcacaagaagacactgcttgccaccttgatcctgggcctgctggccggtcaagccgtcgcagccccctatctgccgcaggcgagcgatcatcgcaacggcgaagtacaaaccgccagcaacgcctggctggaagtagacctgaccgcgtttgaacagaacctgcagactctcaagacccgcctcggagacaagggcccgcagatctgcgccatcatgaaggcggacgcctacggtcacggcatcgatctgctggttccctccgtcatcaaggccgagatcccctgtatcggcatcgccagcaacgaagaggcccgcgtcgctcgcgagaaaggctttaccggtcgcctgatgcgggtgcgcgccgccactcctgtcgaagtggaacaggccctgccctacaagctggaagagctggttggcagcctggtgagtgctcaggggatctccgacatcgccctgcgccacaatacccggatcccggtgcatattggcctcaactccgccggcatgagccgcaacggcatagacctgcgtctggccgattccaagcaagatgcgctggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggacgcctactttgacatggtgcgcccgggcggcctgctctacggcgactccatcccctcctacaccgaatacaaacgggtgatggcattcaagacccaggtggcgtcggttaaccactatccggcaggcaactccgtcggctatgaccgcacctttaccctcaagcgtgactccctgctcgccaacctgccgctcggttacttcgacggctatcgccgtgcgctgagcaacaaggcctatgtactgatccagggtcagaaggtacctgtggtgggcaagacctccatgaacaccatcatggtggacgtgaccgacctcaaaggggtgaaacccggtgatgaagtggtgctgtttggccgtcagggtgaggccgaagtgaaacaggccgatctcgaggagtacaacggtgccctgctggcggacatgtacaccatctggggctacaccaaccccaagaagatcaaccgctaa

SEQ ID NO: 266 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPQASDHRNGEVQTASNAWLEVDLTAFEQNLQTLKTRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIDLRLADSKQDALAMLKLKGITPVGIMTHFPVEEKEDVKLGLAQFKLDSQWLIEAGKLDRSKLTIHAANSFATLEVPDAYFDMVRPGGLLYGDSIPSYTEYKRVMAFKTQVASVNHYPAGNSVGYDRTFTLKRDSLLANLPLGYFDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 267 - DNA, 1224 bp, Unknown
  Obtained from environmental sample
atgcacaagaagacactgctagccaccttgatcctgggcctgctggccggtcaagccgtcgcagccccctatctgcctctggcaagcgatcatcgcaacggcgaagtacaaaccgccagcaacgcctggctggaagtagacctgaccgcgtttgaacagaacctgcagaccctcaagacccgcctcggagacaagggcccgcagatctgcgccatcatgaaggcggatgcctacggtcacggcatcgatctgctggttccctccgtcatcaaggccgagatcccctgtatcggcatcgccagcaacgaagaggcccgcgtcgctcgcgagaaaggctttaccggtcgcctgatgcgggtgcgcgccgccactcctgtcgaagtggaacaggccctgccctacaagctggaagagctggttggcagcctggtgagtgctcaggggatctcagacatcgccctgcgccacaatacccggatcccggtgcatattggcctcaactccgccggcatgagccgcaacggcatagacctgcgtctggccgattccaagcaagatgcgctggccatgctcaagctcaaggggatcaccccggtcggcatcatgacccacttcccggtggaggaaaaagaggacgtcaagctggggctggcccagttcaagctggactcccagtggctgatcgaggcgggcaagctggatcgcagcaagctcaccatccacgcggccaactccttcgccaccctggaagtgccggaggcctactttgacatggtgcgcccgggcggcctcatctacggcgactccatcccctcctacaccgaatacaaacgggtgatggcattcaagacccaggtggcgtcggtcaaccactatccggcaggcaactccgtcggctatgaccgcacctttaccctcaaacgtgactccctgctcgccaacctgccgctcggttactccgacggctatcgccgtgcgctcagcaacaaggcctatgtactgatccagggtcagaaggtacctgtggtgggcaagacctccatgaacaccgtcatggtggacgtgaccgaactcaaaggggtgaaacccggtgatgaagtggtgctgtttggccgtcagggtgaggccgaagtgaaacaggccgatctggaggagtacaacggtgccctgctggcggacatgtacaccatctggggctacaccaaccccaagaagatcaaccgc

SEQ ID NO: 268 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLTAFEQNLQTLKTRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIDLRLADSKQDALAMLKLKGITPVGIMTHFPVEEKEDVKLGLAQFKLDSQWLIEAGKLDRSKLTIHAANSFATLEVPEAYFDMVRPGGLIYGDSIPSYTEYKRVMAFKTQVASVNHYPAGNSVGYDRTFTLKRDSLLANLPLGYSDGYRRALSNKAYVLIQGQKVPVVGKTSMNTVMVDVTELKGVKPGDEVVLFGRQGEAEVKQADLEEYNGALLADMYTIWGYTNPKKINR

SEQ ID NO: 269 - DNA, 1227 bp, Unknown
  Obtained from environmental sample
atgcacaagaagacactgctagcgaccctggtcctcgggttgctcgccggccaggccgtcgccgccccctatctgcccctggccagcgacacccgcaacggtcaggagcagaccgccgccaacgcctggctggaggtggacttgaccgccttcgagcacaacatccagaccctcaaggatcgtctcggcgacaagggcccgcagatctgcgccatcatgaaggccgacgcctacggtcacggcatcgatctgctggtcccctccgtggtcaaggcgggcattccctgcatcggcatcgccagcaatgaagaggcccgcgtggcccgcgagaagggcttcgagggccggctgatgcgggtccgtgcagccaccccggccgaagtggaacaggccctgccctacaagctggaagagctggtgggcagcctggagagcgccaaggggatcgccgacatcgcccagcgccaccataccaccattccggtgcacataggtctgaactccgccggcatgagccgcaacggcatcgacctgcgccaggcaaacgccaaggaagatgccctggccatggtcaagctcaaggggatcaccccggtcggcatcatgacccacttcccggtggaggagaaagaggacgtcaagctggggctggcccagttcaagctggactaccagtggctcatcgacgcgggcaagctggatcgcagcaagctcaccatacacgccgccaactccttcgccaccctggaagtgccggaggcctactttgacatggtacgcccgggcggcatcatctacggtgacaccatcccctcctacaccgaatacaagaaggtgatggcgttcaagacccaggtcgcctcggtgaaccactacccggcgggcaacaccgtcggctatgaccgcaccttcaccctcaagcgcgactccctgctcgccaacctgccgctcggttactccgacggctaccgccgtgcgctgagcaacaaggcctatgtgctgatccagggccagaaggtgcccgtggtgggcaagacctccatgaacaccatcatggtggacgtgaccgatctcaaaggggtgaaacccggtgatgaagtggtgctgttcggccgtcagggtgaggccgaggtgaagcaggcggatctggaggagtacaacggcgccctgctggcggacatgtacaccatctggggttacaccaaccccaagaagatcaatcgctaa

SEQ ID NO: 270 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVLGLLAGQAVAAPYLPLASDTRNGQEQTAANAWLEVDLTAFEHNIQTLKDRLGDKGPQICAIMKADAYGHGIDLLVPSVVKAGIPCIGIASNEEARVAREKGFEGRLMRVRAATPAEVEQALPYKLEELVGSLESAKGIADIAQRHHTTIPVHIGLNSAGMSRNGIDLRQANAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 271 - DNA, 1227 bp, Unknown
  Obtained from environmental sample
atgcacaagaagacactgctcgcgaccctggtcttcgggttgctcgccggccaggccgtcgccgccccctatctacccctggccagcgacacccgcaacggtcaggagcagaccgccgccaacgcctggctggaagtggacttgaccgccttcgagcacaacatccagaccctcaaggatcgcctcggcgacaagggcccgcagatctgcgccatcatgaaggccgatgcctacggtcacggcatcgatctgctggtcccctccgtggtcaaggcgggcattccctgcatcggcatcgccagcaatgaagaggcccgcgtggcccgcgagaagggcttcgagggccgcctgatgcgggtccgtgccgccaccccggccgaagtggagcaggccctgccctacaagctggaagagctggtgggcagcctggagagcgccaaggggatcgccgacatcgcccagcgccaccataccaccattccggtgcacataggtctgaactccgccggcatgagccgcaacggcatcgatcttcgccaggcggacgccaaggaagatgccctggccatggtcaagctcaaggggatcaccccggtcggcatcatgacccacttcccggtggaagaaaaagaggacgtcaagctggggctggcccagttcaagctggactaccagtggctgatcgacgcgggcaagctggatcgcagcaagctcaccatacacgccgccaactccttcgccaccctggaagtgccggacgcctactttgacatggtgcgcccgggcggcatcatctacggtgacaccatcccctcctacaccgaatacaagaaggtgatggcgttcaagacccaggtcgcctcggtgaaccactacccggcgggcaacaccgtcggctatgaccgcaccttcaccctcaagcgtgactccctgctcgccaacctgccgctcggttactccgacggataccgccgtgcgctgagcaacaaggcctatgtgctgatccagggccagaaggtgcccgtggtgggcaagacctccatgaacaccatcatggtggacgtgaccgacctcaaagggctgaaacccggtgatgaagtggtgctgttcggccgtcagggtgaggccgaggtgaagcaggcggatctggaggagtacaacggcgccctgctggcggacatgtacaccatctggggttacaccaaccccaagaagatcaaacgccta

SEQ ID NO: 272 - protein, 409 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCIGIASNEEARVAREKGFEGRLMRVRAATPAEVEQALPYKLEELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPDAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGLKPGDEVVLFGRQGEAEVKQADLEEYNGALLADMYTIWGYTNPKKIKRL

SEQ ID NO: 273 - DNA, 1227 bp, Unknown
  Obtained from environmental sample
atgcacaagaagacactgcttgccaccttgatcctgggcctgctggccggtcaagccgtcgcagccccctatctgccgcaggcgagcgatcatcgcaacggcgaagtacaaaccgccagcaacgcctggttggaagtggatctgggcgccttcgaacacaatatccagaccctcaaggatcgcctcggtgacaagggtccgcagatctgcgccatcatgaaggccgacgcctacggtcatggcatcgacctgctggtcccctccgtggtcaaggccaatatcccctgtatcggcatcgccagcaacgaagaggcccgcgtcgctcgcgagaaggggtttaccggtcgcctgatgcgggtgcgcgccgccactcctgtcgaagtggaacaggccctgccctacaagctggaagagctggttggcagcctggtgagtgctcaggggatctcagacatcgccctgcgccacaatacccggatcccggtgcatattggcctcaactccgccggcatgagccgcaacggcatagacctgcgtctggccgattccaaacaagatgcgctgaccatgctcaagctcaaggggatcaccccggtcggcatcatgacccacttcccggtagaggagaaagaggacgtcaagatggggctggcccagttcaaactggactcccagtggctgctggaagcgggcaagctggatcgcagcaagatcaccatccacgccgccaactccttcgccaccctggaagtgccggatgcctacttcgacatggtgcgcccgggtggcctgctctacggcgactccatcccctcctacaccgaatacaagcgggtgatggcattcaagacccaggtcgcctcggtcaaccactacccggcaggcaactccgtcggctatgaccgcacctttaccctcaaacgtgactccctgctcgccaacctgccgctcggttactccgacggctatcgccgtgcgctgagcaacaaggcctatgtactgatccagggtcagaaggtacctgtggtgggcaagacctccatgaacaccatcatggtggacgtgaccgatctcaaaggggtgaaacccggtgatgaagtggtgctgtttggccgtcagggtgaggccgaagtgaaacaggccgatctggaggagtacaacggtgccctgctggcggacatgtacaccatctggggctacaccaaccccaagaagatcaatcgctaa

SEQ ID NO: 274 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPQASDHRNGEVQTASNAWLEVDLGAFEHNIQTLKDRLGDKGPQICAIMKADAYGHGIDLLVPSVVKANIPCIGIASNEEARVAREKGFTGRLMRVRAATPVEVEQALPYKLEELVGSLVSAQGISDIALRHNTRIPVHIGLNSAGMSRNGIDLRLADSKQDALTMLKLKGITPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 275 - DNA, 1227 bp, Unknown
  Obtained from environmental sample
atgcacaagaagacactgctggccaccttgatcctgggcctgctggccggtcaagccgtcgcagccccctatctgccgcaggcgagcgatcatcgcaacggcgaagtacaaaccgccagcaacgcctggctggaagtagacctgaccgtgtttgaacagaacctgcagactctcaagacccgcctcggcgacaagggcccgcagatctgcgccatcatgaaggcggatgcctacggtcacggcatcgatctgctggttccctccgtggtcaaggccaatatcccctgtatcggcatcgccagcaacgaagaggcccgcgtcgctcgcgagaaaggctttaccggccgcctgatgcgggtgcgcgccgccactcctgtcgaagtggaacaggccctgccctacaagctggaagagctggttggcagcctggtgagtgctcaggggatctcagacatcgccctgcgccacaatacccggatcccggtgcatattggcctcaactccgccggcatgagccgcaacggcatcgacctgcgtctggccgatgccaagcaagatgcgctggccatgctcaagctcaaggggatcaccccggtcggcatcatgacccacttcccggtggaggagaaagaggacgtcaagctggggctggcccagttcaagctggactcccagtggctgctggaagcaggcaagctggatcgcagcaagatcaccatccatgccgccaactccttcgccaccctggcagtgccggacgcctactttgacatggtgcgcccgggcggcctgctctacggcgactccatcccctcctacaccgaatacaagcgggtgatggcattcaagacccaggtcgcctcggtcaaccactatgcggcgggcaacacagtcggttatgaccgcacctttactctcaaacgtgactcctggctcgccaacctgcctctcggttactccgacggctatcgccgtgcgctcagcaacaaggcctatgtgctgatccagggtcagaaggtgccggtggtcggcaagacctccatgaacaccatcatggtggacgtgaccgatctcaaaggggtaaagcccggtgatgaagtggtgctgtttggccgtcagggtgagtcagaagtgaaacaggctgatctggaggagtacaacggcgccctgttggcggacatgtacaccatctggggctacaccaaccccaagaagatcaaccgctga

SEQ ID NO: 276 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPQASDHRNGEVQTASNAWLEVDLTVFEQNLQTLKTRLGDKGPQICAIMKADAYGHGIDLLVPSVVKANIPCIGIASNEEARVAREKGFTGRLMRVRAATPVEVEQALPYKLEELVGSLVSAQGISDIALRHNTRIPVHIGLNSAGMSRNGIDLRLADAKQDALAMLKLKGITPVGIMTHFPVEEKEDVKLGLAQFKLDSQWLLEAGKLDRSKITIHAANSFATLAVPDAYFDMVRPGGLLYGDSIPSYTEYKRVMAFKTQVASVNHYAAGNTVGYDRTFTLKRDSWLANLPLGYSDGYRRALSNKAYVLIQGQKVPVVGKTSMNTIMVDVTDLKGVKPGDEVVLFGRQGESEVKQADLEEYNGALLADMYTIWGYTNPKKINR

SEQ ID NO: 277 - DNA, 1227 bp, Unknown
  Obtained from environmental sample
atgcacaagaagacactgctagcgaccctggtcttcgggttgctcgccggccaggccgtcgccgccccctatctgccgctcgccagcgacacccgcaacggtcaggagcagaccgccgccaacgcctggctggaggtggatttggccgccttcgagcacaacatccagaccctcaaggatcgtctcggcgacaagggcccgcagatctgcgccatcatgaaggccgacgcctacggtcacggcatcgatctgctggtcccctccgtggtcaaggcgggcattccctgcatcggcatcgccagcaatgaagaggcccgcgtggcccgcgagaagggctttgagggccgcctgatgcgggttcgtgccgccaccccggccgaagtggaacaggccctgccctacaagctggaagagctggtgggcagcctggagagcgccaaggggatcgccgacatcgcccagcgccaccataccaccattccggtgcacataggtctgaactccgccggcatgagccgcaacggcatcgatcttcgccaggcggacgccaaggaagatgccctggccatggtcaagctcaaggggatcaccccggtcggcatcatgacccacttcccggtggaagagaaagaggacgtcaagctggggctggcccagttcaagctggactaccagtggctcatcgatgcgggcaagctggatcgcagcaagctcaccatacacgccgccaactccttcgccaccctggaagtgccggaagcctactttgacatggtacgcccgggcggcatcatctacggtgacaccatcccctcctacaccgaatacaagaaggtgatggcgttcaagacccaggtcgcctcggtgaaccactacccggcgggcaacaccgtcggctatgaccgcaccttcaccctcaagcgtgactccctgctcgccaacctgccgctcggctactccgacggctaccgccgtgcgctgagcaacaaggcctatgtgctgatccagggccagaaggtgcccgtggtgggcaagacctccatgaacaccatcatggtggacgtgaccgatctcaaaggggtgaaacccggtgatgaagtggtgctgttcggccgtcagggtgaggccgaggtgaagcaggcggatctggaggagtacaacggcgccctgctggcggacatgtacaccatctggggttacaccaaccccaagaagatcaaccgctga

SEQ ID NO: 278 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLAAFEHNIQTLKDRLGDKGPQICAIMKADAYGHGIDLLVPSVVKAGIPCIGIASNEEARVAREKGFEGRLMRVRAATPAEVEQALPYKLEELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 279 - DNA, 1227 bp, Unknown
  Obtained from environmental sample
atgcacaagaagacactgctagcgaccctggtcttcgggttgctcgccggccaggccgtcgccgccccctacctgccgctcgccagcgacacccgcaacggtcaggagcagaccgccgccaacgcctggctggaggtggacttgaccgccttcgagcacaacatccagaccctcaaggatcgtctcggcgacaagggcccgcagatctgcgccatcatgaaggccgacgcctacggtcacggcatcgatctgctggtcccctccgtggtcaaggcgggcattccctgcatcggcatcgccagcaatgaagaggcccgcgtggcccgcgagaagggcttcgagggccgcctgatgcgggtccgtgccgccaccccggccgaagtggaacaggccctgccctacaagctgaaagagctggtgggcagcctggagagcgccaaggggatcgccgacatcgcccagcgccaccataccaccattccggtgcacataggtctgaactccgccggcatgagccgcaacggcatcgatcttcgccaggcagacgccaaggaagatgccctggccatggtcaagctcaaggggatcaccccggtcggcatcatgacccacttcccggtggaggagaaagaggacgtcaaactggggctggcccagttcaagctggactaccagtggctgatcgacgcgggcaagctggatcgcagcaagctcaccatacacgccgccaactccttcgccaccctggaagtgccggaagcctactttgacatggtgcgcccgggcggcatcatctacggtgacaccatcccctcctacaccgaatacaagaaggtgatggcgttcaagacccaggtcgcctcggtgaaccactacccggcgggcaacaccgtcggctatgaccgcaccttcaccctcaagcgtgactccctgctcgccaacctgccgctcggttactccgacggctaccgccgtgcgctgagcaacaaggcctatgtgctgatccagggccagaaggtgcccgtggtgggcaagacctccatgaataccatcatggtggacgtgaccgatctcaaaggggtgaaacccggtgatgaagtggtgctgttcggccgtcagggtgaggccgaggtgaagcaggcggatctggaggagtacaacggcgccctgctggcggacatgtacaccatctggggttacaccaaccccaagaagatcaaccgctaa

SEQ ID NO: 280 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCIGIASNEEARVAREKGFEGRLMRVRAATPAEVEQALPYKLKELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 281 - DNA, 1227 bp, Unknown
  Obtained from environmental sample
atgcacaagaagacactgctagcgaccctggtcttcgggttgctcgccggccaggccgtcgccgccccctatctgccgctcgccagcgacacccgcaacggtcaggagcagaccgccgccaacgcctggctggaggtggacttgaccgccttcgagcacaacatccagaccctcaaggatcgcctcggcgacaagggcccgcagatctgcgccatcatgaaggccgatgcctacggtcacggtatcgatctgctggtcccctccgtggtcaaggcaggcatcccctgcatcggcatcgccagcaatgaagaggcccgcgtggcccgcgagaagggcttcgagggccgcctgatgcgggtccgtgccgccaccccggccgaagtggaacaggccctaccctacaagctggaagagctggtgggcagcctggagagcgccaaggggatcgccgacatcgcccagcgccaccataccaccattccggtgcacataggtcttaactccgccggcatgagccgcaacggcatcgacctgcgccaggcggacgccaaggaagatgccctggccatggtcaagctcaaggggatcaccccggtcggcatcatgacccacttcccggtggaggagaaagaggacgtcaagctggggctggcccagttcaagctggactaccagtggctgatcgacgcaggcaagctggatcgcagcaagctcaccatacacgccgccaactccttcgccaccctggaagtgccggaagcctactttgacatggtgcgcccgggcggcatcatctacggtgacaccattccctcctacaccgaatacaagaaggtgatggcgttcaagacccaggtcgcctcggtaaaccactacccggcgggcaacaccgtcggctatgaccgcaccttcaccctcaagcgtgactccctgctcgccaacctgccgctgggttactccgatggctaccgccgtgcgctcagcaacaaggcctatgtgctgatccagggccagaaggtgcccgtggtgggcaagacctccatgaacaccatcatggtggacgtgaccgatctcaaaggggtgaaacccggtgatgaagtggtgctgttcggccgtcagggtgaggccgaggtgaagcaggcggatctggaggagtacaacggcgccctgctggcggacatgtacaccatctggggttacaccaaccccaagaagatcaatcgctga

SEQ ID NO: 282 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCIGIASNEEARVAREKGFEGRLMRVRAATPAEVEQALPYKLEELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 283 - DNA, 1227 bp, Unknown
  Obtained from environmental sample
atgcacaagaagacactgctagcgaccctggtcttcgggttgctcgccggccaggccgtcgccgccccctatctgccgctcgccagcgacacccgcaacggtcaggagcagaccgccgccaacgcctggctggaggtggacttgaccgccttcgagcacaacatccagaccctcaaggatcgcctcggcgacaagggcccgcagatctgcgccatcatgaaggccgatgcctacggtcacggtatcgatctgctggtcccctccgtggtcaaggcaggcatcccctgcatcagcatcgccagcaatgaagaggcccgcgtggcccgcgagaagggcttcgagggccgcctgatgcgggtccgtgccgccaccccggccgaagtggaacaggccctaccctacaagctggaagagctggtgggcagcctggagagcgccaaggggatcgccgacatcgcccagcgccaccataccaccattccggtgcacataggtcttaactccgccggcatgagccgcaacggcatcgacctgcgccaggcggacgccaaggaagatgccctggccatggtcaagctcaaggggatcaccccggtcggcatcatgacccacttcccggtggaggagaaagaggacgtcaagctggggctggcccagttcaagctggactaccagtggctgatcgacgcaggcaagctggatcgcagcaagctcaccatacacgccgccaactccttcgccaccctggaagtgccggaagcctactttgacatggtgcgcccgggcggcatcatctacggtgacaccattccctcctacaccgaatacaagaaggtgatggcgttcaagacccaggtcgcctcggtaaaccactacccggcgggcaacaccgtcggctatgaccgcaccttcaccctcaagcgtgactccctgctcgccaacctgccgctgggttactccgatggctaccgccgtgcgctcagcaacaaggcctatgtgctgatccagggccagaaggtgcccgtggtgggcaagacctccatgaacaccatcatggtggacgtgaccgatctcaaaggggtgaaacccggtgacgaagtggtgctgttcggccgtcagggtgaggccgaggtgaagcaggcggatctggaggagtacaacggcgccctgctggcggacatgtacaccatctggggctacaccaaccccaagaagatcaaccgctga

SEQ ID NO: 284 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCISIASNEEARVAREKGFEGRLMRVRAATPAEVEQALPYKLEELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 285 - DNA, 1227 bp, Unknown
  Obtained from environmental sample
atgcacaagaagacactgctagccaccttgatcctgggcctgctggccggtcaagccgtcgcagccccctatctgccgcaggcgagcgatcatcgcaacggcgaagtacaaaccgccagcaacgcctggctggaagtagacctgaccgcgtttgaacagaacctgcagaccctcaagacccgccttggagacaagggcccgcagatctgcgccatcatgaaggcggatgcctacggtcacggcatcgatctgctggttccctccgtcatcaaggccgagatcccctgtatcggcatcgccagcaacgaagaggcccgcgtcgctcgcgagaaaggctttaccggtcgcctgatgcgggtgcgcgccgccactcctgtcgaagtggaacaggccctgccctacaagctggaagagctggttggcagcctggtgagtgctcaggggatctccgacatcgccctgcgccacaatacccggatcccggtgcatattggcctcaattccgccggcatgagccgcaacggcatagacctgcgtctggccgattccaagcaagatgcgctggccatgctcaagctcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggaggcctactttgacatggtgcgcccgggcggcctcatctacggcgactccatcccctcttacaccgaatacaaacgggtgatggcattcaagacccaggtggcgtcggtcaaccactatccggcaggcaactccgtcggctatgaccgcacctttaccctcaagcgtgactccctgctcgccaacctgccgctcggttactccgacggctatcgccgtgcgctgagcaacaaggcctatgtactgatccagggtcagaaggtacctgtggtgggcaagacctccatgaacaccatcatggtggacgtgaccgatctcaaaggggtgaaacccggtgatgaagtggtgctgtttggccgtcagggtgaggccgaagtgaaacaggccgatctcgaggagtacaacggtgccctgctggcggacatgtacaccatctggggctacaccaaccccaagaagatcaaacgctga

SEQ ID NO: 286 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLILGLLAGQAVAAPYLPQASDHRNGEVQTASNAWLEVDLTAFEQNLQTLKTRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIDLRLADSKQDALAMLKLKGITPVGIMTHFPVEEKEDVKLGLAQFKLDSQWLIEAGKLDRSKLTIHAANSFATLEVPEAYFDMVRPGGLIYGDSIPSYTEYKRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 287 - DNA, 1227 bp, Unknown
  Obtained from environmental sample
atgcacaagaagacactgctcgccaccttgatcctgggcctgctggccggtcaagccgtcgcagccccctatctgccgcaggcgagcgatcatcgcaacggcgaagtacaaaccgccagcaacgcctggctggaagtagacctgaccgtgtttgaacagaacctgcagaccctcaagacccgccttggagacaagggcccgcagatctgcgccatcatgaaggcggatgcctacggtcacggcatcgatctgctggttccctccgtcatcaaggccgagatcccctgtatcggcatcgccagcaacgaagaggcccgcgtcgctcgcgagaagggctttaccggtcgcctgatgcgggtgcgcgccgccactcctgtcgaagtggaacaggccctgccctacaagctggaagagctggttggcagcctggtgagtgctcaggggatctccgacatcgccctgcgccacaatacccggatcccggtgcatattggcctcaactccgccggcatgagccgcaacggcatagacctgcgtctggccgattccaagcaagatgcactggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggacgcctactttgacatggtgcgcccgggcggcctgctctacggcgactccatcccctcttacaccgaatacaaacgggtgatggcattcaagacccaggtggcgtcggtcaaccactatccggcaggcaactccgtcggctatgaccgcacttttaccctcaagcgtgactccctgctcgccaacctgccgctcggttactccgacggctatcgccgtgcgctcagcaacaaggcctatgtactgatccagggtcagaaggtacctgtggtgggcaagacctccatgaacaccatcatggtggacgtgaccgacctcaaaggggtgaaacccggtgatgaagtggtgctgtttggccgtcagggtgaggccgaagtgaaacaggccgatctcgaggagtacaacggtgccctgctggcggacatgtacaccatttggggctacaccaaccccaagaagatcaaccgctga

SEQ ID NO: 288 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPQASDHRNGEVQTASNAWLEVDLTVFEQNLQTLKTRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIDLRLADSKQDALAMLKLKGITPVGIMTHFPVEEKEDVKLGLAQFKLDSQWLIEAGKLDRSKLTIHAANSFATLEVPDAYFDMVRPGGLLYGDSIPSYTEYKRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 289 - DNA, 1227 bp, Unknown
  Obtained from environmental sample
atgcacaagaagacactgctagccaccttgatcctgggcctgctggccggtcaagccgtcgcagccccctatctgccgcaggcgagcgatcatcgcaacggcgaagtacaaaccgccagcaacgcctggctggaagtagacctgaccgcgtttgaacagaacctgcagaccctcaagacccgcctcggcgacaagggcccgcagatctgcgccatcatgaaggcggatgcctacggtcacggcatcgatctgctggttccctccgtcatcaaggccgagatcccctgtatcggcatcgccagcaacgaagaggcccgcgtcgctcgcgagaagggctttaccggtcgcctgatgcgggtgcgcgccgccactcctgtcgaagtggaacaggccctgccctacaagctggaagagctggttggcagcctggtgagtgctcaggggatcttcgacatcgccctgcgccacaatacccggatcccggtgcatattggcctcaactccgccggcatgagccgcaacggcatagacctgcgtctggccgattccaagcaagatgcactggccatgctcaaactcaaggggatcaccccggtcggcatcatgacccacttcccggtggaggagaaagaggacgtcaagctggggctggcccagttcaagctagactcccagtggctgatcgaggcgggcaagctggatcgcagcaagctcaccatccacgcggccaactccttcgccaccctggaagtgccggacgcctactttgacatggtgcgcccgggcggcctgctctacggcgactccatcccctcttacaccgaatacaaacgggtgatggcattcaagacccaggtggcgtcggtcaaccactatccggcaggcaactccgtcggctatgaccgcacttttaccctcaagcgtgactccctgctcgccaacctgccgctcggttactccgacggctatcgccgtgcgctcagcaacaaggcctatgtactgatccagggtcagaaggtacctgtggtgggcaagacctccatgaacaccatcatggtggacgtgaccgacctcaaaggggtgaaacccggtgatgaagtggtgctgtttggccgtcagggtgaggccgaagtgaaacaggccgatctcgaggagtacaacggtgccctgctggcggacatgtacactatctggggctacaccaaccccaagaagatcaatcgctaa

SEQ ID NO: 290 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPQASDHRNGEVQTASNAWLEVDLTAFEQNLQTLKTRLGDKGPQICAIMKADAYGHGIDLLVPSVIKAEIPCIGIASNEEARVAREKGFTGRLMRVRAATPVEVEQALPYKLEELVGSLVSAQGIFDIALRHNTRIPVHIGLNSAGMSRNGIDLRLADSKQDALAMLKLKGITPVGIMTHFPVEEKEDVKLGLAQFKLDSQWLIEAGKLDRSKLTIHAANSFATLEVPDAYFDMVRPGGLLYGDSIPSYTEYKRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 291 - DNA, 1227 bp, Unknown
  Obtained from environmental sample
atgcacaagaagacactgcttgcgaccctggtcttcgggttgctcgccggccaggccgtcgccgccccctacctgccgctcgccagcgacacccgcaacggtcaggagcagaccgccgccaacgcctggctggaggtggacttgaccgccttcgagcacaacatccagaccctcaaggatcgtctcggcgacaagggcccgcagatctgcgccatcatgaaggccgacgcctacggtcacggcatcgatctgctggtcccctccgtggtcaaggcgggcattccctgcatcggcatcgccagcaatgaagaggcccgcgtggcccgcgggaagggcttcgagggccgcctgatgcgggtccgtgccgccaccccggccgaagtggaacaggccctgccctacaagctggaagagctagtgggcagcctggagagcgccaaggggatcgccgacatcgcccagcgccaccataccaccattccggtgcacataggtctgaactccgccggcatgagccgcaacggcatcgatcttcgccaggcggacgccaaggaagatgccctggccatggtcaagctcaaggggatcaccccggtcggcatcatgacccacttcccggtggaggagaaagaggacgtcaagctggggctggcacagttcaagctggactaccagtggctcatcgatgcgggcaagctggatcgcagcaagctcaccatacacgccgccaactccttcgccaccctggaagtgccggaagcctactttgacatggtacgcccgggcggcatcatctacggtgacaccatcccctcctacaccgaatacaagaaggtgatggcgttcaagacccaggtcgcctcggtgaatcactacccggcgggcaacaccgtcggctatgaccgcaccttcaccctcaagcgcgactccctgctcgccaacctgccgctgggttactccgacggctaccgccgtgcgctgagcaacaaggcctatgtgctgatccagggccagaaggtgcccgtggtgggcaagacctccatgaacaccatcatggtggacgtgaccgatctcaaaggggtgaaacccggtgatgaagtggtgctgttcggccgtcagggtgaggccgaggtgaagcaggcggatctggaggagtacaacggcgccctgctggcggacatgtacaccatctgggattacaccaaccccaagaagatcaaccgctga

SEQ ID NO: 292 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLVFGLLAGQAVAAPYLPLASDTRNGQEQTAANAWLEVDLTAFEHNIQTLKDRLGDKGPQICAIMKADAYGHGIDLLVPSVVKAGIPCIGIASNEEARVARGKGFEGRLMRVRAATPAEVEQALPYKLEELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWDYTNPKKINR

SEQ ID NO: 293 - DNA, 1227 bp, Unknown
  Obtained from environmental sample
atgcacaagaagacactgctcgccaccttgatcctgggcctgctggccggtcaagccgtcgcagccccctatctgcctctggcaagcgatcatcgcaacggcgaagtacaaaccgccagcaacgcctggctggaagtagacctgaccgcgtctgaacagaatctgcagaccctcaagacccgcctcggcgacaagggcccgcagatctgcgccatcatgaaggcggacgcctacggtcacggcatcgacctgctggttccctccgtcatcaaggccgagatcccctgtatcggcatcgccagcaacgaagaggcccgcgtcgctcgcgagaaaggctttaccggccgcctgatgcgggtgcgcgccgccactcctgtcgaagtggaacaggccctgccctacaagctggaagagctggttggcagcctggtgagtgctcaggggatctccgatatcgccctgcgccacaatacccggatcccggtgcatattggcctcaattccgccggcatgagccgcaacggcataggcctgcgtctgaccgatgccaagcaagatgcgctggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggaggcctactttgacatggtgcgcccgggcggcctcatctacggcgactccatcccctcctacaccgaatacagacgggtgatggcattcaagacccaggtggcgtcggttaaccactatccggcaggcaactccgtcggctatgaccgcacctttaccctcaaacgtgactccctgctcgccaacctgccgctcggttactccgacggctatcgccgtgcgctcagcaacaaggcctatgtactgatccagggtcagaaggtacctgtggtgggcaagacctccatgaacaccatcatggtggacgtgaccgatctcataggggtgaaacccggtgatgaagtggtgctgtttggccgtcagggtgaggccgaagtgaaacaggccgatctggaggagtacaacggtgccctgctggcggacatgtacaccatctggggctacaccaaccccaagaagatcaatcgctaa

SEQ ID NO: 294 - protein, 408 aa, Unknown
  Obtained from environmental sample
  SIGNAL (1)...(21)
  DOMAIN (41)...(272): Alanine racemase, N-terminal domain
  DOMAIN (279)...(396): Alanine racemase, C-terminal domain
  SITE (72)...(82): Alanine racemase pyridoxal-phosphate attachment site. Prosite id = PS00395
MHKKTLLATLILGLLAGQAVAAPYLPLASDHRNGEVQTASNAWLEVDLTASEQNLQTLKTRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIGLRLTDAKQDALAMLKLKGITPVGIMTHFPVEEKEDVKLGLAQFKLDSQWLIEAGKLDRSKLTIHAANSFATLEVPEAYFDMVRPGGLIYGDSIPSYTEYRRVMAFKTQVASVNHYPAGNSVGYDRTFTLKRDSLLANLPLGYSDGYRRALSNKAYVLIQGQKVPVVGKTSMNTIMVDVTDLIGVKPGDEVVLFGRQGEAEVKQADLEEYNGALLADMYTIWGYTNPKKINR

SEQ ID NO: 295 - DNA, 1224 bp, Unknown
  Obtained from environmental sample
atgcacaagaagacactgctggctaccctgatcttcggcctgctcgcgggccaagccgttgcggctccctatctgccccttgcgacggatcatcgcaacggccaggagcaaaccgccagcaacgcctggttggaagtggatctgggcgcctttgaacacaatatccagaccctcaaggatcgcctcggcgacaggggcccgcagatctgcgccatcatgaaggccgacgcttacggtcatggcatcgacctgctggtcccctccgtggtcaaggcaaatatcccctgcatcggcatcgccagcaacgaagaggcgcgcgtcgcccgcgagaagggctttaccggccgtctgatgcgggtgcgtgctgccaccccggatgaagtagagcaggccctgccctacaagatggaggagctgatcggcagtctggtcagtgcccagggtatcgccgatatcgcccagcgccaccacaccaccattccggtgcatattgcactcaactccgccggcatgagccgcaacggcatcgacctgcgtctggccgatgccaagcaggatgcgctggctatgctcaagctcaaggggatcaccccggtcggcatcatgacccacttcccggttgaggagaaagaggacgtcaagatggggctggcccagttcaaactggactcccagtggctgctggaagcgggcaagctggatcgcagcaagatcaccatccacgccgccaactccttcgccaccctggccgtgccggacgcctacttcgacatggtgcgcccgggtggcctgctctacggcgactccatcccctcccataccgagtacaagcgggtgatggcattcaagacccaggtcgcctcggtcaaccactttgcagcgggcaacaccgtcggttatgaccgcacctttaccctcaagcgtgactcctggctcgccaacctgccgctcggttactccgacggttatcgccgctccctgagcaacaaggcctatgtgctgatcaagggtcagaaggtgccggtggtcggcaagacctccatgaacaccatcatggtggacgtgaccgatctgaaaggggtcaaacccggtgacgaggtggtgctgtttggccgtcagggaagtgccgaggtgaaacaggcggatctggaggagtacaacggcgccctgctggcggacatgtacaccatctggggctacaccaaccccaagaagatcaagcgc

SEQ ID NO: 296 - protein, 408 aa, Unknown
  Obtained from environmental sample
  SIGNAL (1)...(21)
  DOMAIN (41)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
MHKKTLLATLIFGLLAGQAVAAPYLPLATDHRNGQEQTASNAWLEVDLGAFEHNIQTLKDRLGDRGPQICAIMKADAYGHGIDLLVPSVVKANIPCIGIASNEEARVAREKGFTGRLMRVRAATPDEVEQALPYKMEELIGSLVSAQGIADIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHFAAGNTVGYDRTFTLKRDSWLANLPLGYSDGYRRSLSNKAYVLIKGQKVPVVGKTSMNTIMVDVTDLKGVKPGDEVVLFGRQGSAEVKQADLEEYNGALLADMYTIWGYTNPKKIKR

SEQ ID NO: 297 - DNA, 960 bp, Unknown
  Obtained from environmental sample
atgaacatcaacccgagcgttcgcgtcgttgattcccacacgggcggcgaacccacgcgcgtggttgtcagcggcgggcccgacttgggcagtggctcgatcgaatcccgcctgaaactttttcgcgagaaattcgattcgtttcgctccgccgtcatcaatgaaccgcgcgggtcggacattctggtcggcgcgctgctctgcgcgccggtcgatccatcgaacgcctgtggcgtgatctttttcaacaatgtcggctatcttggcatgtgcggacacggaaccatcgggctggtcgcgacgctcgcgtatctcaaaaagatcgcgcccggcgaacatcgcattgaaaccttcgtcggcaccgtcacggcgcgactgcatgagtcgggcgaagtctccgtgaaaaacgtgccgagctaccgtctgtccaaagatgttgccgttgatgtgaaggggctcggcacttttaccggtgacattgcttggggcggaaactggttctttctggtgaaacagccgcgcgaagatcttctactgaagaacgcggaaagcctgaccgaagccgcgtggaaaatccgccaggcgctcaccgagaaaggcatcaccggcagcgatggcggcgaaatcgatcacatcgaatttttcggcccgccgaaaacttctggcgccgacagccgcaattttgtgctctgccccggcaaggcgtacgaccgttcgccctgcggcacgggcacgagcgcgaagctggcgtgtctttttgcggacggaaaactgcggccgggccagacctggaagcaggagagcatcaccggtagcatatttacaggcagcgttgaagaagtcgccggaagtgttccgcacacggtgctgccgaccatccagggcagcgcgttcattaccggcgaaacggcgctgatttttgatccgcgggaccccttgaaactgggattgcgaacgtga

SEQ ID NO: 298 - protein, 319 aa, Unknown
  Obtained from environmental sample
  DOMAIN (9)...(318): Proline racemase
MNINPSVRVVDSHTGGEPTRVVVSGGPDLGSGSIESRLKLFREKFDSFRSAVINEPRGSDILVGALLCAPVDPSNACGVIFFNNVGYLGMCGHGTIGLVATLAYLKKIAPGEHRIETFVGTVTARLHESGEVSVKNVPSYRLSKDVAVDVKGLGTFTGDIAWGGNWFFLVKQPREDLLLKNAESLTEAAWKIRQALTEKGITGSDGGEIDHIEFFGPPKTSGADSRNFVLCPGKAYDRSPCGTGTSAKLACLFADGKLRPGQTWKQESITGSIFTGSVEEVAGSVPHTVLPTIQGSAFITGETALIFDPRDPLKLGLRT

SEQ ID NO: 299 - DNA, 1230 bp, Unknown
  Obtained from environmental sample
atgccttttacccgtactgtgctcgccctgtccctcggtctggttctgctgcaaagccaggtccacgccgcgccgccgttgtcgatgagcaacggcaatacgattctgaccacacaaatcagcaacgcctggatcgaaatcaacaaggccgcattcgagcacaacattcgcaccctgcaagccgagctggacggcaagtcgaagctttgcgcagtgctcaaggccgacgcctacggtcacggcattggcttgctgatgccctcggtgattgcgctgggcgtgccctgcgtggcgatcgccagcaacgaagaggcgcgcgtggtgcgcgagagtggcttcaagggtcagttgatccgggtccgtcagggggctttgagcgagatcgacaatgccttgcagtacaacgtcgaagagctggtgggcaacctcgacctcgctcgccaagcagctgaggtggcgcagaagcaggggcgcaagttgcaggtgcacatcgccctcaactccagtggcatgagccgtaacggcctggaaatgaacagcgaacagggcaagcaggacgccctggcgatcacccagctgccgaacgtcgaagtgctggcgataatgacccactacgcagtggaagagcgcgaggacgtgctcaagggcttggccgcgttcaaggaacagtccgcctggctgatggacaaggcgcagctcgaccgcagcaagatcactctgcacaccgccaactccttcgccaccctggaagtgcccgaggcgcggttggacatggtgcgtaccggcggcgcgctgtttggcgacactgtcatcgagcgcaccgaatacaagaaggtcatgcagttcaagtcgcacgtggcctcggtcaacagctacccggccggcaacaccgtcggttacgaccgcacctacaccctggcgcgggattcgaagctggccaacatcaccgtcggctactccgatggctaccgccgggtgttcaccaataagggcatcgtgctgatcaatggtcaccgcgtgccggtggtcggcaaggtctcgatgaataccttgatggtcgatgtcaccgacgtcccgagcgtgcgcccaggcgatgaggtggtgctgttcggcaagcagggcgcggtggaaaccagccagacggaaatggaggaggccaacggtgcgctgctggccgacctgtacaccgtttggggcagcgccaacccgaagattctggtggataaataa

SEQ ID NO: 300 - protein, 409 aa, Unknown
  Obtained from environmental sample
  SIGNAL (1)...(23)
  DOMAIN (42)...(271): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
  SITE (169)...(172): N-glycosylation site. Prosite id = PS00001
  SITE (318)...(321): N-glycosylation site. Prosite id = PS00001
MPFTRTVLALSLGLVLLQSQVHAAPPLSMSNGNTILTTQISNAWIEINKAAFEHNIRTLQAELDGKSKLCAVLKADAYGHGIGLLMPSVIALGVPCVAIASNEEARVVRESGFKGQLIRVRQGALSEIDNALQYNVEELVGNLDLARQAAEVAQKQGRKLQVHIALNSSGMSRNGLEMNSEQGKQDALAITQLPNVEVLAIMTHYAVEEREDVLKGLAAFKEQSAWLMDKAQLDRSKITLHTANSFATLEVPEARLDMVRTGGALFGDTVIERTEYKKVMQFKSHVASVNSYPAGNTVGYDRTYTLARDSKLANITVGYSDGYRRVFTNKGIVLINGHRVPVVGKVSMNTLMVDVTDVPSVRPGDEVVLFGKQGAVETSQTEMEEANGALLADLYTVWGSANPKILVDK

SEQ ID NO: 301 - DNA, 1239 bp, Unknown
  Obtained from environmental sample
atgaaatttacccctaccctgctggccgttgccctggccggctgcctgtctacccaggtgcaggccgcccccgaactgcccgttaccggcctggataccagcagtgcccagctcacttccgccaacgcctgggtggaagtcgatcaggcggcgttcgagcacaatattcgcaccttgcagaccctgctcgacggcaagtcgcagatctgtgccatcatgaaggccgacgcctacggccatggcatcgccaacctgatgccctcggtgatggccgccaatatcccctgcatcggcattaccagcaacgaagaagcccgagtggtgcgggaaagcggctatcaagggcgcatcatgcgggtacgcagcgccacgccggcggaagtaagcgatggtctgcaatacgagatggaagagctgttcggcgatatcgaggcggcccgccaggcggccgaggtggccaaggccgccggcaagaccctgcgttatcacctgggcctgaatgccggcggcatgagccgcaacggcctggaagtggcgaccgaagccggcaagcaggaagcccgcgagctgctggcgcaggagaatctggaactggtcggcattatgacccatttccagtatgaagacgcggacttcgtgcgcgccgggctggccaaattcaatgaacagtctaagtggctgatcgaagacggcaagctggatcgcagcaagctgaccctgcatgcggccaactccttcaccaccctggaagtgccggaagcccggctggatatggttcgccccggcggcatcatctatggcgacaccattccttcctataccgaatacaagaaggtgatgtcgttcaagacccgggtggcgtcggtcaacaactacccggccggcagcctggtgggctatgacggcacctataccctggagcgggattcactgctggccaacctgccgatgggctattccgacggttaccgccgggtgttcaccaacagggcctatgtggtggtcaacggccagcgggcgccggtggtgggcaaggtgtcgatgaacaccaccatgatcgatgtgaccgatattccgggcgtcaagccgggggatgaagtggtgctgttcggcaagcagggcggggcggaagtcacccagggcgagctggaagacgccaacggcgccctgctggcggacctgtacacggtgtggggcaactccaaccccaagatcctcaaacccgtggtcagccagtaa

SEQ ID NO: 302 - protein, 412 aa, Unknown
  Obtained from environmental sample
  SIGNAL (1)...(22)
  DOMAIN (42)...(272): Alanine racemase, N-terminal domain
  DOMAIN (279)...(407): Alanine racemase, C-terminal domain
  SITE (72)...(82): Alanine racemase pyridoxal-phosphate attachment site. Prosite id = PS00395
  SITE (354)...(357): N-glycosylation site. Prosite id = PS00001
MKFTPTLLAVALAGCLSTQVQAAPELPVTGLDTSSAQLTSANAWVEVDQAAFEHNIRTLQTLLDGKSQICAIMKADAYGHGIANLMPSVMAANIPCIGITSNEEARVVRESGYQGRIMRVRSATPAEVSDGLQYEMEELFGDIEAARQAAEVAKAAGKTLRYHLGLNAGGMSRNGLEVATEAGKQEARELLAQENLELVGIMTHFQYEDADFVRAGLAKFNEQSKWLIEDGKLDRSKLTLHAANSFTTLEVPEARLDMVRPGGIIYGDTIPSYTEYKKVMSFKTRVASVNNYPAGSLVGYDGTYTLERDSLLANLPMGYSDGYRRVFTNRAYVVVNGQRAPVVGKVSMNTTMIDVTDIPGVKPGDEVVLFGKQGGAEVTQGELEDANGALLADLYTVWGNSNPKILKPVVSQ

SEQ ID NO: 303 - DNA, 375 bp, Unknown
  Obtained from environmental sample
cgccaggtcttgaatgccggcggttatccggaaatcgatcatgtcgaactattcggcccaccgaagctgaatcacgcccactcgcgaaatttcgtactttgccccggtaaggcgtacgatcgttcggcctgtggcacgggcacgagcgcgaaactggcctgcctggcggccgacggcaagctggccgaaggcgagccgtgggtgcaggaaagcatcgtcggcagcaccttcaccggccactatcgctggctcgaccgcgctgccggcacgatcgagccaacgatccgcggtcaggccttcatcaccggcgagacggtgctggtgctggatgatgccgaccctttccgcaacggcttcgccggaccagcgctatga

SEQ ID NO: 304 - protein, 124 aa, Unknown
  Obtained from environmental sample
  DOMAIN (1)...(120): Proline racemase
RQVLNAGGYPEIDHVELFGPPKLNHAHSRNFVLCPGKAYDRSACGTGTSAKLACLAADGKLAEGEPWVQESIVGSTFTGHYRWLDRAAGTIEPTIRGQAFITGETVLVLDDADPFRNGFAGPAL

SEQ ID NO: 305 - DNA, 1125 bp, Unknown
  Obtained from environmental sample
atggacgacaaagtgacggaacaactcgatctcggcggtgcctccgggatcctgacgatcgacctgggcgcgctgcgccggaactatcaggcgctctccgccatggccggggcggcagaaatcgccgccgtggtcaaggcggatgcctatggccttggtgtcgatcatgtcgtcccggcgctcttcgatgccggctgccggagctttttcgtcgcccagcttcaggaagcgacggcggtcaagcgcgccctcgcgggcagcgacgttcggatcttcgtcctcaacgggctccagcccggggaggagatggcctgcgtcgcgcgcggcgccgttcccgtcctcaactcgctcgagcaggccgacaactgggcgtccgtggcccgcacgctcaagacacggcttgcggccgtgctgcaggtcgacaccggcatgtcccgcctgggcatgtctcaggatgatctgcacgcgctggccgccggccgcgatcgtctcgacgggctcgatctcctctacgtgatgagtcatctcgcatccgccgaggatggatcgaacgcatccaacgccgcccaactcgccgctctgcgagaggccgcggtggtctttcccggcgtgccggtgtgcctggccaattccggcggcatctttctcggccgcgactatcacggcgcgcttgcccgccccggcatcgccctctatggcggcgcgccggtcgccggcaagcccaatgccatgcagccggttgtacgcctcgatgccgccgtgatccagacgcgcaccgtccccgcagggacccgcgtcggctatggcggcagccacgtcaccgggagcgagcggcggctcgcgaccatcgcggccggctatgccgacggactgccccgcgcgctcagcaaccgcggcgccgcttattttgaaggcatacgcctgcccattgccgggatcgtctcgatggacagcatcacgctcgacatcaccgacctgccgccggctacgctgaaaatcggaagtctggtcgaactgatcggaccccaccagacgctcgaagggctggcggccgatgccggcacaatctcctatgaaatcctgacaggtctcggccggcgctacaggcgcatctaccggtactga

SEQ ID NO: 306 - protein, 374 aa, Unknown
  Obtained from environmental sample
  DOMAIN (15)...(237): Alanine racemase, N-terminal domain
  DOMAIN (247)...(373): Alanine racemase, C-terminal domain
  SITE (43)...(53): Alanine racemase pyridoxal-phosphate attachment site. Prosite id = PS00395
  SITE (186)...(189): N-glycosylation site. Prosite id = PS00001
MDDKVTEQLDLGGASGILTIDLGALRRNYQALSAMAGAAEIAAVVKADAYGLGVDHVVPALFDAGCRSFFVAQLQEATAVKRALAGSDVRIFVLNGLQPGEEMACVARGAVPVLNSLEQADNWASVARTLKTRLAAVLQVDTGMSRLGMSQDDLHALAAGRDRLDGLDLLYVMSHLASAEDGSNASNAAQLAALREAAVVFPGVPVCLANSGGIFLGRDYHGALARPGIALYGGAPVAGKPNAMQPVVRLDAAVIQTRTVPAGTRVGYGGSHVTGSERRLATIAAGYADGLPRALSNRGAAYFEGIRLPIAGIVSMDSITLDITDLPPATLKIGSLVELIGPHQTLEGLAADAGTISYEILTGLGRRYRRIYRY

SEQ ID NO: 307 - DNA, 429 bp, Unknown
  Obtained from environmental sample
ttgataggttggagccgcgtactgagagagaacatcaatgcaacgtattcctttgttcacccggaagaccccaccattaacgggtgcagtcatatcctgtggaccggcaaagttcttgatccttcatccaccgcgcgcaatgcagtcttttatggtgacaaggccatcgaccgctcaccgtgcggaacgggcacctcagcgcggctggcccaatggtttgccaaaggaaaactgaagcccggtgatgagttcattcacgaaagcattatcggttcaaaattcatcggcaggattgaggagattaccaaacttgatggtaagccggccatcgttccaagtgtggagggctgggcaaagatatatggcttcaataccatcaccatcgatccggaggatgatccgtatgcgtatgggtttcaggtaatttga

SEQ ID NO: 308 - protein, 142 aa, Unknown
  Obtained from environmental sample
  DOMAIN (1)...(140): Proline racemase
  SITE (13)...(16): N-glycosylation site. Prosite id = PS00001
MIGWSRVLRENINATYSFVHPEDPTINGCSHILWTGKVLDPSSTARNAVFYGDKAIDRSPCGTGTSARLAQWFAKGKLKPGDEFIHESIIGSKFIGRIEEITKLDGKPAIVPSVEGWAKIYGFNTITIDPEDDPYAYGFQVI

SEQ ID NO: 309 - DNA, 405 bp, Unknown
  Obtained from environmental sample
atgcgcccagcccgcgcgctgatcgacctggacgcgctgcgcagcaactaccgcctggcccgtgagctgggcggcggcaaggcgctggcggtggtcaaggccgatgcgtatggccatggcgcggtgcgctgcgcgcaggccctgcagggcgaagccgatggttttgccgtggctgccatcgaagaagcactggagctgcgcgcggcgggcatccgcgcgcccatcctgctgctggaaggcttcttcgacgccgatgagctgccgctcatcgtccagcaccagctgtggacggccgtggggtcgccctggcaggtggacgcgctggcggcattcgagagcgaccagccgctgacggtctggctgaagctggacagcggcatgcaccggctgggactggatccaaag

SEQ ID NO: 310 - protein, 135 aa, Unknown
  Obtained from environmental sample
  DOMAIN (3)...(135): Alanine racemase, N-terminal domain
  SITE (30)...(40): Alanine racemase pyridoxal-phosphate attachment site. Prosite id = PS00395
MRPARALIDLDALRSNYRLARELGGGKALAVVKADAYGHGAVRCAQALQGEADGFAVAAIEEALELRAAGIRAPILLLEGFFDADELPLIVQHQLWTAVGSPWQVDALAAFESDQPLTVWLKLDSGMHRLGLDPK

SEQ ID NO: 311 - DNA, 939 bp, Unknown
  Obtained from environmental sample
gtgttcaagctggcgcaagtgttcaccatttctcgtgggtcacgcacggaagcaaaagtgctgacggtgcgcatcgaggaagatggcgttgttggatggggcgaatgtgtgccttatgcgcgctatggcgagacgcttgagtcggtcacaaaagagatcgaaagcgtgcgtggtgatgtgaaccgtgaggggctgtacacgttgcccgctggtgcggcgcgcaatgcgctggattgtgcgctgtgggatcttgaggccaaaaagactggcaaaagagtttgggatctggccggattggccgcacctaagcctgaaatcaccgcctatactttgtcgctggacacgccaaaaaacatgcaagagcaggccgcaaaacatgcgttccgcccgctgctcaagattaaactgggcacgcctgacgatatggcgcgtttggaagctgtgcgcgctggtgcgccaaaatcgaccattattgtggatgccaacgaaggttggtcggctgcggtctatgctgatctggcgccacatcttgtgcggttgggcgtggccttggttgagcagcctttgccggcgggcgaggatgaggcgttgattggcatggatcggcctgtgcctgtttgtgcggacgaaagctgtcatgatcgcgccagcttggcggggctgaaaggcaaatatgatgtggtcaacatcaagctcgacaaaaccggcgggctgaccgaagcgttgcgcctgcgggatgcggcgttggctgagggctgtaaagtgatggtgggctgcatggtcgggtcgtctttggcgatggcaccggccacattggtggcccaaggcgcgatggtgacagaccttgacgggccgctgttgttggccgaagaccgtgaaaatccactgaagtttgatgatgccggagtgcatgcgccaagcgcagcactttggggctga

SEQ ID NO: 312 - protein, 312 aa, Unknown
  Obtained from environmental sample
  DOMAIN (1)...(98): Mandelate racemase / muconate lactonizing enzyme, N-terminal domain
  DOMAIN (116)...(205): Mandelate racemase / muconate lactonizing enzyme, C-terminal domain
MFKLAQVFTISRGSRTEAKVLTVRIEEDGVVGWGECVPYARYGETLESVTKEIESVRGDVNREGLYTLPAGAARNALDCALWDLEAKKTGKRVWDLAGLAAPKPEITAYTLSLDTPKNMQEQAAKHAFRPLLKIKLGTPDDMARLEAVRAGAPKSTIIVDANEGWSAAVYADLAPHLVRLGVALVEQPLPAGEDEALIGMDRPVPVCADESCHDRASLAGLKGKYDVVNIKLDKTGGLTEALRLRDAALAEGCKVMVGCMVGSSLAMAPATLVAQGAMVTDLDGPLLLAEDRENPLKFDDAGVHAPSAALWG

SEQ ID NO: 313 - DNA, 909 bp, Unknown
  Obtained from environmental sample
cggctcgaggcacggcgagcgcattttttggaagaatgggattggattcggactgggctcatgtttgaacctagggggcatgatatgatgtcggggtccatcttatatgaaccgaccagggacgattgtgatgtcgctattcttttcatagaaacaagcggatgcctacccatgtgtggccacggaaccattggaacggttaccgtcatgattcaggagggcctcgttcatccagaaactcctggtttggtgcggctggatacgcctgctggacgagtggacgcctactacgaaatggaaaatgggcgtgtgacgagtgttaggctcatcaacatcccttcttttttgtacaaatcggatctcaaggtggaatgtcctgacctgggagagatatcggttgacgtcggatatggtggaaatttttacgcgatcgtagatcaccagaaaaacttttcggatatcgcggactttacagcatccgacctcattcgatggagcccgattgtccgaacccggctcaacgagctttacgacttcacccatccaaacgatgaacgtatttgcggaatgagccacatgttatggacgggggccccggttgtggaaggctccgacgcacggaatgctgtgttttatggcaacaaagcgattgaccgatccccatgtggcacaggcacttccagccggatggcacagtgggcagctcagggaaaactaaaaaagggtgatacgtttgtacacgaaagtatcattggaagtcagtttgtcgggaaagttgaagacaccgcgaaagtaggcgattttgacgccattattcccagcataaagggatgggcacgtgtcatggggtacaatgaaatcctgattgacgacgacgacccatacgcacacggatttcaggtgatttag

SEQ ID NO: 314 - protein, 302 aa, Unknown
  Obtained from environmental sample
  DOMAIN (2)...(300): Proline racemase
  SITE (152)...(155): N-glycosylation site. Prosite id = PS00001
RLEARRAHFLEEWDWIRTGLMFEPRGHDMMSGSILYEPTRDDCDVAILFIETSGCLPMCGHGTIGTVTVMIQEGLVHPETPGLVRLDTPAGRVDAYYEMENGRVTSVRLINIPSFLYKSDLKVECPDLGEISVDVGYGGNFYAIVDHQKNFSDIADFTASDLIRWSPIVRTRLNELYDFTHPNDERICGMSHMLWTGAPVVEGSDARNAVFYGNKAIDRSPCGTGTSSRMAQWAAQGKLKKGDTFVHESIIGSQFVGKVEDTAKVGDFDAIIPSIKGWARVMGYNEILIDDDDPYAHGFQVI

SEQ ID NO: 315 - DNA, 684 bp, Unknown
  Obtained from environmental sample
cggctcgagcccggaaggattcgtatggagaccccagcaggtttggttaagattcaataccagcagactggaaaaaaagtagattgggtaaaattgacgaatgtcaaatcctatttggctgcttcagaactcaccataaattgtacggatctaggggaactaattttcgatgtttcctatgggggcaattattatgcaatttttgatccccaaaaaaatttcaagggaattcaggaatattctgcgagcaaactgatacaatacagtcaagaaattagagaaaagatcaatctaaaataccctgattgctttatccatccagagaatgaaactatcaatggcgttagccatattctttggacaggcagcactatatcaccagaggccacggcaagaaatgccgttttctatggggacaaggctatagacagatcaccctgcggcactggtacctcagcgcgaatggcgcaatggcacgctaagggaaaattaggggtaggagtagcgtttattcacgaaagttttattggatctcaatttataggtcaggtggaagaagaaactacactgtccggcaagatggccattatcccaagtatacaagggtgggcccaggtctacggatacaacaatataattatagacgatgatgatccttatgcacacggatttcaagtaatttag

SEQ ID NO: 316 - protein, 227 aa, Unknown
  Obtained from environmental sample
  DOMAIN (1)...(225): Proline racemase
  SITE (47)...(50): N-glycosylation site. Prosite id = PS00001
  SITE (110)...(113): N-glycosylation site. Prosite id = PS00001
RLEPGRIRMETPAGLVKIQYQQTGKKVDWVKLTNVKSYLAASELTINCTDLGELIFDVSYGGNYYAIFDPQKNFKGIQEYSASKLIQYSQEIREKINLKYPDCFIHPENETINGVSHILWTGSTISPEATARNAVFYGDKAIDRSPCGTGTSARMAQWHAKGKLGVGVAFIHESFIGSQFIGQVEEETTLSGKMAIIPSIQGWAQVYGYNNIIIDDDDPYAHGFQVI

SEQ ID NO: 317 - DNA, 1032 bp, Unknown
  Obtained from environmental sample
atgaagatcgagtttcacacgctgtatctgaaaaagcgctttcccttgcggatttcacgcggtgaaattctgggcgacgagaacctgtttgtctcggtcagtgatggtacgctgacaggttggggcgaaatggcccccggctacaccgaaggcgccgcaactgcaacagaggggcgcacgcaactggaagctttctgcgcaaccgggctggagggcgcgatacatgacatctgggcgcgtgcccatgcgggcggtgttggcgcatgtgcgctggcggcgctggacatggccctttgggatttgcgcgccaaacaggcgaatatgccgctatacagcctgttggggctggcgcggcggggcgttgtgtcatcgctgactgtgggcatcaacccgccagatgtggtgtctgaccgtgtgcccctgttgctggcgcgcggggcgcgtgcgctgaaggtaaaactgggcagcacagacggcattgacgcggacaaggccatgttcacggcagtgcatgacgcggcagcaggcagcggcgcggccctgcgggtagacgccaacggcggctggtcgctgcgcgacgcgcgccacatgatggactggttggccaggcgcggcgtggaatatgtcgaacaaccccttgttcagggcgccgaggaccagttgcccggcctgttccagtcccgcgccctgccaatatttgttgatgaatcctgccggttttccagcgacattcccgccttcgcgcattgtgtggacggggtgaacctgaagctgatgaaagcgggcggcattacagaagcgctgcgcattgtcgccacggcccgcgcgcatgggctgaaaaccatgatcggctgcatgggggaaagctccgtggctattgctgcgggcgcgtccctgtcagcgctgtttgactatatcgaccttgattcccaccttaatcttgatcccgacccggccagcggcgcgcctttcatggatggtgtgaccctgcccgaagaccgacccggccacggaggatgcctgaatgcttga

SEQ ID NO: 318 - protein, 343 aa, Unknown
  Obtained from environmental sample
  DOMAIN (2)...(115): Mandelate racemase / muconate lactonizing enzyme, N-terminal domain
  DOMAIN (132)...(231): Mandelate racemase / muconate lactonizing enzyme, C-terminal domain
  SITE (91)...(116): Mandelate racemase / muconate lactonizing enzyme family signature 1. Prosite id = PS00908
MKIEFHTLYLKKRFPLRISRGEILGDENLFVSVSDGTLTGWGEMAPGYTEGAATATEGRTQLEAFCATGLEGAIHDIWARAHAGGVGACALAALDMALWDLRAKQANMPLYSLLGLARRGVVSSLTVGINPPDVVSDRVPLLLARGARALKVKLGSTDGIDADKAMFTAVHDAAAGSGAALRVDANGGWSLRDARHMMDWLARRGVEYVEQPLVQGAEDQLPGLFQSRALPIFVDESCRFSSDIPAFAHCVDGVNLKLMKAGGITEALRIVATARAHGLKTMIGCMGESSVAIAAGASLSALFDYIDLDSHLNLDPDPASGAPFMDGVTLPEDRPGHGGCLNA

SEQ ID NO: 319 - DNA, 636 bp, Unknown
  Obtained from environmental sample
agaattcggcacgagaccggagatcacttgttggaaactccggtgggcgttgtgaaaacgacggtccacgattccgctcgggtgagcgtggagaatgtaccgagttatctataccgctcaaacgtggaagtcgacgttcccggcttaggagtcgtttccggcgacgtcgcatatgggggcaattggttttatttggtcggcgaccaccgagaacaaatcgagccaaataatatcgagcgactgctggcggttacgaaagcgatccgcgccgccttggcagcctctgggattacgggcgagagcggggcggagatcgaccacatcgaactgtttggtccacccggccagttggttgccaacgcgagaaacttcgtgctatgccctgggggcgcttacgaccgatcgccgtgcgggacggggaccagcgccaagctggcctgtttggccgcttccgacaagttgctccccgggcaggcttggcggcaagccagcatcacggggagtatttttgaagcgacgtatcgttgggacggcgaccggatcattccacggtttaccgggtcggcctacgtctgcggcttaacgaccttgctgtttgaccccgacgatccattgcgcgaggggtttcgatggtga

SEQ ID NO: 320 - protein, 211 aa, Unknown
  Obtained from environmental sample
  DOMAIN (1)...(210): Proline racemase
RIRHETGDHLLETPVGVVKTTVHDSARVSVENVPSYLYRSNVEVDVPGLGVVSGDVAYGGNWFYLVGDHREQIEPNNIERLLAVTKAIRAALAASGITGESGAEIDHIELFGPPGQLVANARNFVLCPGGAYDRSPCGTGTSAKLACLAASDKLLPGQAWRQASITGSIFEATYRWDGDRIIPRFTGSAYVCGLTTLLFDPDDPLREGFRW

SEQ ID NO: 321 - DNA, 699 bp, Unknown
  Obtained from environmental sample
atgaaaagtgcaggcattataggaggtttagggccggaaactacagctgagttttacctggatgtgattgatggttttaaatcaagaaagtttccacagcggccaagcctatatattgcgaatgttcccgttgtcctggcatatgaacaggaatttattttaaatagcaaagggattgaaaggtttttaccttacctgctcaatgaagcaaggaaccttgaaaaggctggcagcgattttatcgtgatgccttgtaattcccttcatttctatattgaagacctgcgcaggcacgtccgtattcctgtactttcaatagttgaagaggctgtaaaatttattgagttaaaggggatcagggaagtcggatttatatcgacggcagggacttccaaattggaactttatgatcaacagtttcgaaagaaaaaaatagagtatcataaaccggatccccaaaagcaaaaggaaattgatttgattatcagtaggttgctgcaaggtataaagaccgtgaatgatcgtgctaaactcatagatattatcggccatttcaatacattcggtgtagagcatcttctccttgcatgtacagaccttcagattcttgatccaattcatcctgaaatacacgtttatgacacaatgaaaatactcgctgaggccaccattgatttcatgcttgggactaaggcttaa

SEQ ID NO: 322 - protein, 232 aa, Unknown
  Obtained from environmental sample
  DOMAIN (3)...(228): Asp/Glu/Hydantoin racemase
MKSAGIIGGLGPETTAEFYLDVIDGFKSRKFPQRPSLYIANVPVVLAYEQEFILNSKGIERFLPYLLNEARNLEKAGSDFIVMPCNSLHFYIEDLRRHVRIPVLSIVEEAVKFIELKGIREVGFISTAGTSKLELYDQQFRKKKIEYHKPDPQKQKEIDLIISRLLQGIKTVNDRAKLIDIIGHFNTFGVEHLLLACTDLQILDPIHPEIHVYDTMKILAEATIDFMLGTKA

SEQ ID NO: 323 - DNA, 885 bp, Unknown
  Obtained from environmental sample
gaattcgattggattcgaaagggattgatgtttgagccgcgcggacacgatatgatgagcgggagcattttatttccaccacataatgaggaaaatgatttttcgattttatttattgaaacttccggttgtttgcccatgtgcggccatggaacaattggaacagtaaccattgctattgaagaaggtttgataacgccaaaaattcccggtaaaataagaatggaagcaccggccggactggtgcaaattgaataccagcaaaccggtaaaaaagtggattgggtgaaattaatcaatgtgaaatcgtatttggctgcggaagggttaacagttgattgtccggaattgggtgaacttacttttgatgtggcttatggcggaaattattatgctattattgattcacaagaaaattttagcggcgtacatgattttacggcaagcaaattagtgcagtattcacaagtggtgagaacgcgcatcaataataaatacccaaatttatttgtacatccgcaaaatgaaaccatcaaagatgtgagccatatgttgtggacaggaaatccaattgatccatcttcttctggcagaaatgctgttttttacggagacaaagccatagatcgctcaccttgcggcacaggaacatcggcccggatggcgcaattatatgcaaaaggcaaattaaaactgggagaggaatacatccacgaaagttatattggctctaaatttattggcaaaattgtggaagaaacaactttggacgggaaaaaagcgattgttccaagtatacaaggctgggcaaaagtttatggatacaacaccataattattgatgatgaagatgatccgtatgcacacggatttcaggtgttataa

SEQ ID NO: 324 - protein, 294 aa, Unknown
  Obtained from environmental sample
  DOMAIN (1)...(292): Proline racemase
  SITE (141)...(144): N-glycosylation site. Prosite id = PS00001
  SITE (177)...(180): N-glycosylation site. Prosite id = PS00001
EFDWIRKGLMFEPRGHDMMSGSILFPPHNEENDFSILFIETSGCLPMCGHGTIGTVTIAIEEGLITPKIPGKIRMEAPAGLVQIEYQQTGKKVDWVKLINVKSYLAAEGLTVDCPELGELTFDVAYGGNYYAIIDSQENFSGVHDFTASKLVQYSQVVRTRINNKYPNLFVHPQNETIKDVSHMLWTGNPIDPSSSGRNAVFYGDKAIDRSPCGTGTSARMAQLYAKGKLKLGEEYIHESYIGSKFIGKIVEETTLDGKKAIVPSIQGWAKVYGYNTIIIDDEDDPYAHGFQVL

SEQ ID NO: 325 - DNA, 1005 bp, Unknown
  Obtained from environmental sample
atgccttccaaaacttttttttgtgtagatgctcatacctgtggaaaccctgtgagagtggtagcgggcggagggcctgtgttatcgggcaatagcatgtttgagaaaaggcgacatttcctggaagaatacgactggatcaggaaaggtcttatgtttgagccccggggccacgatatgatgtcgggaagtattttatatcctccgtctgatcctgcaaatgatgtggggatattgtttatcgaaaccagcgggtgtctgcccatgtgcgggcatggcaccatcggcacagtgacggtagctatcgaacagggattggtacaacctaaaataccgggacgcctccaccttgagactccggcaggtttggtaaaggtctcctacgtaaccgagggaaaaaaagtcaaatcagtaaagctggtaaatataccgtcattcctggcaggcaaagatcttaaggtgaacctgccccaattgggagatatttactttgatgtggcttatggaggcaatttttatgcgattgtagatccacaggagaacttctccggcatacaagcctatacggctgaggaactgattgcaatgagtcgcgatctcagaaaaatcatcaacgaacattatcaattcagccatccggaaaacccaggaataagcggagtttctcatatccaatggacaggagaaacaatttcgaaagaagcacatggcaggaatgccgtcttttatggcgacaaggccatcgaccgctcaccttgcggcacgggcacgtcagcgagaatagcacaatggcacgccagggggaagctgaaggtaggcgatactttcattcacgagagcattataggcagcaggtttgtcggtcgggtagaatcaaccacaaaagttggagacttccctgccatcgttccctccatagaaggttgggctaaagtcaccggtttcaataccattataattgacgatgaagatgacccttatgcacacggattccaggtgatatag

SEQ ID NO: 326 - protein, 334 aa, Unknown
  Obtained from environmental sample
  DOMAIN (8)...(332): Proline racemase
  SITE (183)...(186): N-glycosylation site. Prosite id = PS00001
MPSKTFFCVDAHTCGNPVRVVAGGGPVLSGNSMFEKRRHFLEEYDWIRKGLMFEPRGHDMMSGSILYPPSDPANDVGILFIETSGCLPMCGHGTIGTVTVAIEQGLVQPKIPGRLHLETPAGLVKVSYVTEGKKVKSVKLVNIPSFLAGKDLKVNLPQLGDIYFDVAYGGNFYAIVDPQENFSGIQAYTAEELIAMSRDLRKIINEHYQFSHPENPGISGVSHIQWTGETISKEAHGRNAVFYGDKAIDRSPCGTGTSARIAQWHARGKLKVGDTFIHESIIGSRFVGRVESTTKVGDFPAIVPSIEGWAKVTGFNTIIIDDEDDPYAHGFQVI

SEQ ID NO: 327 - DNA, 1002 bp, Unknown
  Obtained from environmental sample
atgggaagtaaaacttttttttgtatagatgcccatacctgcggaaacccggtgcggttggttgctggcggtggcccggtgctcaaaggagcaaacatgagcgaaaagagacaacattttctcagcgaatacgactggatacgtacgggactgatgttcgagccgcgaggtcatgatatgatgtcgggcagtatactttatccgccccatgatcctgagaatgatgtagcggttttatttattgaaacgagcggctgtctccctatgtgtggtcatggtaccatcggaacaattactattgccattgaagaaggattgattcagcccaaagtgcccggggttgtaagaatggaagcccctgccggacttgtactgattgattatcaacaagtggacggtaaagtgcaatcggtgaaattgagaaacgtaccttcttatctggcggcggaaagcctggaggtagactgcccggacctggggatgttgaaatttgatgtcgcctacggcggtaacttttatgcgatcattgatcctcaggaacattttcccggtttggagtattttacagctgcgcagctgattgcatggagtcaggtgatcagatcaagaatcaatgaaaagtattcttttgtgcatccattagattttacgataaacggttgtagccatatcctctggacaggaaagcctatcgactccagttcctcagcccgaaacgcagttttttatggtgaaaaggccatagaccgttcgccttgcggaaccggaacttctgcaagaatggctcagctgcacgcaaaaggtaaacttgcgcagggcgaagactttgttcacgaaagcgtaatcggcagcaagtttactggcagggtggagggagtaacgaagctcgagcaatatgatgcgatcattccaagtgtggaaggctgggcaaaggtatttggttacaataccattaaaattgatgatgacgatccttatgcccacgggtttcaggtgatttag

SEQ ID NO: 328 - protein, 333 aa, Unknown
  Obtained from environmental sample
  DOMAIN (8)...(331): Proline racemase
  SITE (32)...(35): N-glycosylation site. Prosite id = PS00001
MGSKTFFCIDAHTCGNPVRLVAGGGPVLKGANMSEKRQHFLSEYDWIRTGLMFEPRGHDMMSGSILYPPHDPENDVAVLFIETSGCLPMCGHGTIGTITIAIEEGLIQPKVPGVVRMEAPAGLVLIDYQQVDGKVQSVKLRNVPSYLAAESLEVDCPDLGMLKFDVAYGGNFYAIIDPQEHFPGLEYFTAAQLIAWSQVIRSRINEKYSFVHPLDFTINGCSHILWTGKPIDSSSSARNAVFYGEKAIDRSPCGTGTSARMAQLHAKGKLAQGEDFVHESVIGSKFTGRVEGVTKLEQYDAIIPSVEGWAKVFGYNTIKIDDDDPYAHGFQVI

SEQ ID NO: 329 - DNA, 957 bp, Unknown
  Obtained from environmental sample
atgccatacgatccgaggatgcctgcccctttgcgccgcgtgcggttcgtcgactcccacaccgggggcgagcctacgcgtgtcgtgctcgagggcgggcccgaccttggcggcggcccgctcgcggagcgcgtggagcgtttccgccgcgagcacgatcgctggcggcgcgcgatcgtgtgcgagccgcgcggatcggacacggtcgtcggtgcgctgctcgtgccgccgcatgcgccgggctgcgacgctggcgcgatcttcttcaacaacgtcggctacctcggcatgtgcggccacggcacgatcgggctcgtggcgacgctcgcgcatctcggccggatcgacgcgggcacggtgcgtatcgacacaccggctggcgcggtcgcgtgcgaactgcacgccgacgggcgcgtgtcggttgcgaatgtcgagagccatcgcgagcgcgcgggcctcgtcgtcgaagtgcccggaatcggcgcggtgcgcggcgacgtggcctacggcggcaactggtttttcctcacacacagtcacggacaggagctcgatgcgtcgcggatgccgcagctcacggattgctcgacccggatccttgcggcggtgcgcgcggctggatttccgcaggtcgaccatgtggaactcacaggaccgggccgcgcgccgggcgcgaactccagcgcgtttgtcctctgccccgggctcgcctacgaccgttcgccgtgcggcacgggcacgagtgcgcggctcgcgtgcctcgcggccgacggtgcgctcgccgagggcgaggagtgggtgcaggagagcatcatcggaagcacgttcgcggcgcgctacgtgtgggccgaccgcgcgaccgggcggatccggccgacgatcacgggcacggcgcacgtgaacgccgagggcgagcagatcatcgacgggcgcgacccgtttgcgtgggggatctga

SEQ ID NO: 330 - protein, 318 aa, Unknown
  Obtained from environmental sample
  DOMAIN (16)...(318): Proline racemase
  SITE (229)...(232): N-glycosylation site. Prosite id = PS00001
MPYDPRMPAPLRRVRFVDSHTGGEPTRVVLEGGPDLGGGPLAERVERFRREHDRWRRAIVCEPRGSDTVVGALLVPPHAPGCDAGAIFFNNVGYLGMCGHGTIGLVATLAHLGRIDAGTVRIDTPAGAVACELHADGRVSVANVESHRERAGLVVEVPGIGAVRGDVAYGGNWFFLTHSHGQELDASRMPQLTDCSTRILAAVRAAGFPQVDHVELTGPGRAPGANSSAFVLCPGLAYDRSPCGTGTSARLACLAADGALAEGEEWVQESIIGSTFAARYVWADRATGRIRPTITGTAHVNAEGEQIIDGRDPFAWGI

SEQ ID NO: 331 - DNA, 420 bp, Unknown
  Obtained from environmental sample
cccaatgatgccgcccccaatcctatgcaggcggtggtaagcctgcatgtcgcggttatacagacccgtaacgtacccgccggtacacagatcggttatggcagcacctataccgctgcgcgtgacatgcggttggcgaccctcggcgccggttatgccgacggcctgccgcgatccttaagcccgcgcggtgcggcctggcatagtgatacccgcctgccgatcgtcgggcggatatcgatggacagtttgatggtcgatatcaccgacctgccgccaggtgcggtggccgaaggtgatttcgtcgaactgattggcccgcatcagtcgatcgacgccattgccgctgatgccggcaccatttcctacgaaatcctgacggcgctcggccgtcgtttctaccgcgaatatcggggctag

SEQ ID NO: 332 - protein, 139 aa, Unknown
  Obtained from environmental sample
  DOMAIN (12)...(138): Alanine racemase, C-terminal domain
PNDAAPNPMQAVVSLHVAVIQTRNVPAGTQIGYGSTYTAARDMRLATLGAGYADGLPRSLSPRGAAWHSDTRLPIVGRISMDSLMVDITDLPPGAVAEGDFVELIGPHQSIDAIAADAGTISYEILTALGRRFYREYRG

SEQ ID NO: 333 - DNA, 939 bp, Unknown
  Obtained from environmental sample
ctttacgcggagggatgccgggatttcttcgtggcgcaatatgccgaggccgtgacgcttcgtccgctcctgccgcgcgatgccgcgctttacgtgttgaacggcctgcagccgggcatcgaaggtgattgcgccgcacgtgacatcatccccgtcctgaattcgctggaacaggtggtgcgctggcgcacgacggccgaactttctggccgcccgctgaaggcactgctgcagtttgataccggcatgtcgcgtctcggcatggcgactgaggaggccgaagcgcttgccgccgatccgacgcttctctccggcattgagatcctctacgtcatgagccacctcgcctgcgctgacgaggcggaagatccgcataatgctgatcaggccgagatgatgcgccggttttccagcagttttccgggcattcccgtctgtttcggcaattccgccggtgcttttctgggtgaaagctttcgcggtgctctggtgcgtcccggcattgccctttacggcgcacgtcccaccgatattctcgaacggccgatggagccggtggtgaagatcgaggcgcgcgtcatccagacgcgcaccgtgctatcaggcaccgccatcggctattcggcaacctatgtgaccgacagcgaacggcaattggccaccgtggcgctcggttatgcggacgggttgccgcgcgcgctcagcaatcgcggcgcgctttatttcaggggtcatcgccttcccattctcgggcgggtgtcgatggacagcaccatcatcgacatcagtgacctcgagccgggcacgctgacgcttggcagccttgtcgaattcatcggggaacaccagacgctggaagacgtggcggaaaccgccggcaccatttcctgggagatcctcaccggcatcggccatcgctactttcgccagtatcgctga

SEQ ID NO: 334 - protein, 312 aa, Unknown
  Obtained from environmental sample
  DOMAIN (1)...(176): Alanine racemase, N-terminal domain
  DOMAIN (186)...(312): Alanine racemase, C-terminal domain
LYAEGCRDFFVAQYAEAVTLRPLLPRDAALYVLNGLQPGIEGDCAARDIIPVLNSLEQVVRWRTTAELSGRPLKALLQFDTGMSRLGMATEEAEALAADPTLLSGIEILYVMSHLACADEAEDPHNADQAEMMRRFSSSFPGIPVCFGNSAGAFLGESFRGALVRPGIALYGARPTDILERPMEPVVKIEARVIQTRTVLSGTAIGYSATYVTDSERQLATVALGYADGLPRALSNRGALYFRGHRLPILGRVSMDSTIIDISDLEPGTLTLGSLVEFIGEHQTLEDVAETAGTISWEILTGIGHRYFRQYR

SEQ ID NO: 335 - DNA, 1143 bp, Unknown
  Obtained from environmental sample
atgagaacgagacatcgatgctgggccgagatcgatctggatgcgcttcgcgaaaaccttgcgtggctgcgtcattgtgtcggtccggacgtgaagatcatgaccgtggtcaaagcggacgcctacggacatggccttaaggagatcgcggcgctcctgatgcagagcggcaccgacatctttggagtcgcgaacctcgcggaggcgcgcagtgtgcacgctgtggggcggggctggcccgttctgatgctgggcgcgtgtttgccggaagaggtggagtcggcggtgcgtgacggggtgatgccgacaatctcctcgatcgaagaggcgcgccaattctcccgcgtcggagtccgattgaaccgactggtcaatgcccacatcaaagtggacacgggaatgggccggctcggagttgatccgggtcgcgcggttgatctgatccttcggaccgcgcaactgccgggagtccgggtcgccggagtgttcacgcacttcgcgtcggtcgaagacgacgcgacgttttccagaacgcagcgcgaatggttcgtgaaaattctggccgacctgaaagttcggggagtcgatgtttcgatggttcacgcgaacaacagtggcgcggtattgcacgagccgaactcgatgttcacgttgattcgaccggggctgctggtttatggcatcctgccgtccggcaaacgcaggttcacatcgaccttgcaacgccatctgcggcccgccctcgcgctaaaatgccgtgtcgggctggtgaaggagatccagcgagggatgtcgctcagctacggccgcacgtttgtcgcacctcggaaaatgcgggtggcgaccgtcacggctgggtacggtgatggctatatgcgggcgggaagcaatcgggctcaggtgctgattcgcggcaggcgatgccgcgtcctgggcaggatcacgatggatcagacgatggtcgatgtgtcgggcttgcggagtattgaggttggagacgaggtggtcctgatcggacggcagaagaacgaagagatccgggtatctgaactggccgggtggtgtgggacaattccgtgggaagtgctgaccgcgatctcgcatcgcgttccgagagtctatcgcggcagtcacgcagcctga

SEQ ID NO: 336 - protein, 380 aa, Unknown
  Obtained from environmental sample
  DOMAIN (6)...(231): Alanine racemase, N-terminal domain
  DOMAIN (247)...(375): Alanine racemase, C-terminal domain
  SITE (36)...(45): Alanine racemase pyridoxal-phosphate attachment site. Prosite id = PS00395
  SITE (206)...(209): N-glycosylation site. Prosite id = PS00001
MRTRHRCWAEIDLDALRENLAWLRHCVGPDVKIMTVVKADAYGHGLKEIAALLMQSGTDIFGVANLAEARSVHAVGRGWPVLMLGACLPEEVESAVRDGVMPTISSIEEARQFSRVGVRLNRLVNAHIKVDTGMGRLGVDPGRAVDLILRTAQLPGVRVAGVFTHFASVEDDATFSRTQREWFVKILADLKVRGVDVSMVHANNSGAVLHEPNSMFTLIRPGLLVYGILPSGKRRFTSTLQRHLRPALALKCRVGLVKEIQRGMSLSYGRTFVAPRKMRVATVTAGYGDGYMRAGSNRAQVLIRGRRCRVLGRITMDQTMVDVSGLRSIEVGDEVVLIGRQKNEEIRVSELAGWCGTIPWEVLTAISHRVPRVYRGSHAA

SEQ ID NO: 337 - DNA, 1107 bp, Unknown
  Obtained from environmental sample
atgcaccgcgtctgggctgaaatcgacaccgcagccgtgcgccacaacctgcgtagcgtgcgcgagcgcgcagccggggcgcgcgtgatggcggtgctgaaggccaacgcctacgggcacggcgccgtcgagatggcgcggctgctggcatcagagggcattgactgcatcggcgtcggcgacagtggcgaggcgcttgagctgcgcgatgccggcatcgacatgcccattttgattgtcggcggaatcattcccggcgaaatgccgcgcgtggtcgccaacgacatcgaaatcaacctgcacacgggcgagatggccgcggagctcaatgccgaggccgagcgccaggggcggtgcgtacgcgttcacctcaagatcgacaccggcatgggccgccttggcatgcagccctttgaagccgtgccgttcctgcacaacatgcggcgcatgaaggggcttgagctggtgggcctgtgcacgcacttcagtacgccctatgaggacaacccggcgttcaccacgcgccagattgagtacttcaatcttgcggtcgagcttgcgcagcgccttggctatgaggggctgacgctgcacagcagttcaagccttgcggtctggggtcgcgatgacgcgcagttcaacatggtgcgcacgggcatcgcgctgtggggaatgttgccgggcggcaagccggactgggaagcggcactgaagccggcgttgcaactcaagagccgcatcctgtttctgaaagacgtccctgagggcacgcctgtaggctacaaccgcctgtattacacgccggctcccacacgcatcgcgactctgccggtggggtacaacgacggctaccgtaccagcctgagcaaccgcgcttacgtgctggttcgcggtgtgcgttgcgcggtggtggggcgcatcagcatggattacgccacgctggatgtgggacacgtgccggacgtggcggtgggggatgaggcggtgctgatcggccagcagggcggcgaggcaatctcgctgtacgacgtcgccgggtgggcggaagctatcccatacgaaatcctgtgcggtttggggcgtcgcgtggcgcgtgtgtatgtgtga

SEQ ID NO: 338 - protein, 368 aa, Unknown
  Obtained from environmental sample
  DOMAIN (3)...(228): Alanine racemase, N-terminal domain
  DOMAIN (240)...(368): Alanine racemase, C-terminal domain
  SITE (31)...(41): Alanine racemase pyridoxal-phosphate attachment site. Prosite id = PS00395
MHRVWAEIDTAAVRHNLRSVRERAAGARVMAVLKANAYGHGAVEMARLLASEGIDCIGVGDSGEALELRDAGIDMPILIVGGIIPGEMPRVVANDIEINLHTGEMAAELNAEAERQGRCVRVHLKIDTGMGRLGMQPFEAVPFLHNMRRMKGLELVGLCTHFSTPYEDNPAFTTRQIEYFNLAVELAQRLGYEGLTLHSSSSLAVWGRDDAQFNMVRTGIALWGMLPGGKPDWEAALKPALQLKSRILFLKDVPEGTPVGYNRLYYTPAPTRIATLPVGYNDGYRTSLSNRAYVLVRGVRCAVVGRISMDYATLDVGHVPDVAVGDEAVLIGQQGGEAISLYDVAGWAEAIPYEILCGLGRRVARVYV

SEQ ID NO: 339 - DNA, 1068 bp, Unknown
  Obtained from environmental sample
gtgagaccagctcgcgttagcattgatctcgcggcgcttcagcataattactcgctagccaagcgcctgcacggtggcaaggtgtttgcggtggtcaaagccaatgcttacggccacggcgtggtgcggtgcgcgcaggcgctggaagcacacgcggacgggtttgctgtcgcgtgcattgaagaagcgctcaccctgcgcggcgctggcttcgccgcgccgattctcttgttggagggcgtattcgaagcgagcgaattgaatctggtcacgcatcacgacttgtggattgccgtcgccacgcaggaacaggtcgagatgatcgaatccagccctgtagcggcgccactcaacgtgtggatcaaggtcgatagtggcatgcatcggctcggcctgtcgccggccgaggcgcctgccgtgttcgagcgtctgcaggccagcggcaaggtcggcagcattcgctggatgacgcacttcgcccgggctgacgaaaccgacgtccctaccacgcacagccagatcgagacatttcacgcctccacccgtggcctgcccggcgaaatcagcctcagcaactccgccggcatgttggcgcatcgccgcgccgatggtgattggggccgcgccgggatcatgttgtatggctcgtcgccatttgccgaacggtcggcagtggaactcggcttgcgccccgtgatgaagttggaaagcaaactgattgccgtgcgcgacatcgctgcaggcgaggccgtcggctatggcggcagtttcgtggcgcagcgaccgacgcgaattggtgtggtggcaatgggctatgcagacggctatccgcgagtggtcccgacgggcacacccgtcgcagtagatgggcggcttgcacgtatcgtcgggcgcgtgtcgatggatatgctgaccgttgacctcaacgaactacccaatgcccgcatcggcagcgacgtcgagctgtggggcgacattgtgccagtcgatgcgatcgctaagcaggcaggaacaatctcatatgaattgctgtgcaatgtgaagcgggcgacattcaactggaactag

SEQ ID NO: 340 - protein, 355 aa, Unknown
  Obtained from environmental sample
  DOMAIN (3)...(219): Alanine racemase, N-terminal domain
  DOMAIN (232)...(352): Alanine racemase, C-terminal domain
  SITE (16)...(19): N-glycosylation site. Prosite id = PS00001
  SITE (30)...(40): Alanine racemase pyridoxal-phosphate attachment site. Prosite id = PS00395
MRPARVSIDLAALQHNYSLAKRLHGGKVFAVVKANAYGHGVVRCAQALEAHADGFAVACIEEALTLRGAGFAAPILLLEGVFEASELNLVTHHDLWIAVATQEQVEMIESSPVAAPLNVWIKVDSGMHRLGLSPAEAPAVFERLQASGKVGSIRWMTHFARADETDVPTTHSQIETFHASTRGLPGEISLSNSAGMLAHRRADGDWGRAGIMLYGSSPFAERSAVELGLRPVMKLESKLIAVRDIAAGEAVGYGGSFVAQRPTRIGVVAMGYADGYPRVVPTGTPVAVDGRLARIVGRVSMDMLTVDLNELPNARIGSDVELWGDIVPVDAIAKQAGTISYELLCNVKRATFNWN

SEQ ID NO: 341 - DNA, 990 bp, Unknown
  Obtained from environmental sample
atgcctattgctctcgcctaccgcgtggaagcgctgccgctgcacgagcccttccagatcgccggccatcgtttcgtcgacgtgccggtgctgcaactgcgcctgcgcgacggcccccatgagggccagggcgaggcggcgggcgtctactacctggacgaccggccgctcggcatggcacgccgggtcgaatcggtgcgcgcagccatcgaggccggcggcttcgaccgccagtggctgcgcagcctgctgccgcccggcggcgcccgcaacgcgctcgactgcgcgctgtgggcgctggaggcttcgcgtgcgcgggtgcccgtctggcaactggccggcctgcccggcacgcggtcgctgcggaccaccttcacgctcggcgctgccgcgcccgagacgatggccgccggtgcgctcgcctatgccggcgcccgtgccttgaagctcaagctcaccggcgaaggcgcgctcgacgtcgcgcggatccgcgccgtgcgtgccgctcgccccgacgcctggctcagcgtcgacgccaaccagggctacgcgctggacacgatcgccgagctgctgccggcgctggtggactgcggcatcgcgctgctggagcagcctttcgcacgcggtcgcgagcaggacatgcgcgaagtcggcttcccggtgcccaccgcggccgacgaaagctgcctcgacctgaacgagctggagcgcatcgccggcctgttcgacatggtcaacatcaagctcgacaagtgcggcggcctgaccgagggcctgatgatcgccagacgcgctcgcgagctgggcctcaaggtgatggtcggcaacatgggcggcagcagcctggcgatggcgcccgccttcgtgctgggccagggctgcgacgtcgtcgacctcgacgggccgaccatcctggcgcaggactgcacgccggccgtcagctacggcgacggatacatcgactgccccgtcgaggtgtgggcttag

SEQ ID NO: 342 - protein, 329 aa, Unknown
  Obtained from environmental sample
  DOMAIN (3)...(114): Mandelate racemase / muconate lactonizing enzyme, N-terminal domain
  DOMAIN (132)...(225): Mandelate racemase / muconate lactonizing enzyme, C-terminal domain
MPIALAYRVEALPLHEPFQIAGHRFVDVPVLQLRLRDGPHEGQGEAAGVYYLDDRPLGMARRVESVRAAIEAGGFDRQWLRSLLPPGGARNALDCALWALEASRARVPVWQLAGLPGTRSLRTTFTLGAAAPETMAAGALAYAGARALKLKLTGEGALDVARIRAVRAARPDAWLSVDANQGYALDTIAELLPALVDCGIALLEQPFARGREQDMREVGFPVPTAADESCLDLNELERIAGLFDMVNIKLDKCGGLTEGLMIARRARELGLKVMVGNMGGSSLAMAPAFVLGQGCDVVDLDGPTILAQDCTPAVSYGDGYIDCPVEVWA

SEQ ID NO: 343 - DNA, 1134 bp, Unknown
  Obtained from environmental sample
atgaacgcgagaatggccggtatgtccgcccaggtgatcgatcccgtcgcctcgggctatctcaccatcgatctcggtgcgatccgccgaaactacctcaagcttaccgatatgctggcgcccgcgcgtaccgcagccgtggtcaaggcggatgcctacgggcttggtgcgcgaccggtggccgaggcgctctaccaggccggatgccgtgacttcttcacggcgcatttttccgaggccgcaacccttcgccccgtacttgcagacgatgccatcctctatgtcctgaatggtctccagcccggcaacgaggcggcctgtgccgcagccggtgtcattccggttttgaattctctcgagcaggtgcgtcgctggggcgagacggccacgctgatgggcaaggcgctcgccgccgccattcagttcgataccggcatgtcgcggcttggcctgtcgcctgtggagcaggcgctgttgaaggccgaactggcccatcatccgcttatcgatatccggttcatcatgagccatctcgcctctgccgatgaggcagacagtgcccagaacggcgagcagattgccgagatggagcggattgcggcggagtttcccgagtttccggtctgtttttccaattccggcggggtgtttctcggcaagcgcttccatcatctgatggcacgccccggaattgctacctatggtggaaatccgacgccgaatgcggtcaatccgatggagccgaccgtcagcctgaagatcgccgtggtccagacgcggacggtgcctgccggcgccaaggtcggttatggcgcgaccttcgtggcgcccaaggaaatgcgtcttgccaccattgctgcaggatacgccgacggattgccacgcagcctcagtgatcgcggtgccgtctattatggtgatgtgcgcctgccgatcgtcggacgcgtttcgatggacagcatgacggtcgatatcagcagcctgccggaaggaacgctcatgctcggcagcctggtggagatgatcggtccgcaccagtcgctggatgatcttgcgcaggcggccggaacgatttcctatgaggtgctgaccagcctcggccagcgctatcggcgcgaatatttaaaaccttga

SEQ ID NO: 344 - protein, 377 aa, Unknown
  Obtained from environmental sample
  DOMAIN (18)...(239): Alanine racemase, N-terminal domain
  DOMAIN (249)...(375): Alanine racemase, C-terminal domain
  SITE (46)...(56): Alanine racemase pyridoxal-phosphate attachment site. Prosite id = PS00395
MNARMAGMSAQVIDPVASGYLTIDLGAIRRNYLKLTDMLAPARTAAVVKADAYGLGARPVAEALYQAGCRDFFTAHFSEAATLRPVLADDAILYVLNGLQPGNEAACAAAGVIPVLNSLEQVRRWGETATLMGKALAAAIQFDTGMSRLGLSPVEQALLKAELAHHPLIDIRFIMSHLASADEADSAQNGEQIAEMERIAAEFPEFPVCFSNSGGVFLGKRFHHLMARPGIATYGGNPTPNAVNPMEPTVSLKIAVVQTRTVPAGAKVGYGATFVAPKEMRLATIAAGYADGLPRSLSDRGAVYYGDVRLPIVGRVSMDSMTVDISSLPEGTLMLGSLVEMIGPHQSLDDLAQAAGTISYEVLTSLGQRYRREYLKP

SEQ ID NO: 345 - DNA, 777 bp, Unknown
  Obtained from environmental sample
tcgctggaacaggtgggtcgctggcgcagcacggggaagctgtcgggcaaggtccttccggcgctgctgcagttcgatacgggcatgtcgcgcctcggcatgtcggcggaagaagccgaagccctggccgccgatcccgcactcctcgatggcattgccctccgctacatcatgagccaccttgcctgtgcggatgagtcggaagacccgcacaatgccctccaagcagaagcgatgcggcggttttcttccatcttccccggcgtgccgatctccttcggcaattctgccggctcgtttctcggcgaagcctaccgaggcgcgctcgtgcgtcccggtatcgcgctgtacggcggacgtccgaccgatcttctcgacaaaccgatggaaccggtggtccggatcgaagccgccgtcatccagacgcgcaccgtgcccgccggtacggcggtcggttattcagccacctatgtggcgccgcaggagcgtcgtctcgccaccgtggcgctcggttatgccgatggtatcctgagggcgctcagcaatcgcggcgccttcttccacgacaatgtgcggctgccgatcgtcggtcgcgtctccatggacagcaccatcatcgatataagcgacctgccggaggggacgctcaaactcggctcgacagtcgagtttcttggaccccaccagtccctggaagacgtggcggaatgtgccggcacgatttcctgggaagtgctgaccagcatcggccagcggtatcaccgcacctatctctga

SEQ ID NO: 346 - protein, 258 aa, Unknown
  Obtained from environmental sample
  DOMAIN (1)...(122): Alanine racemase, N-terminal domain
  DOMAIN (132)...(258): Alanine racemase, C-terminal domain
SLEQVGRWRSTGKLSGKVLPALLQFDTGMSRLGMSAEEAEALAADPALLDGIALRYIMSHLACADESEDPHNALQAEAMRRFSSIFPGVPISFGNSAGSFLGEAYRGALVRPGIALYGGRPTDLLDKPMEPVVRIEAAVIQTRTVPAGTAVGYSATYVAPQERRLATVALGYADGILRALSNRGAFFHDNVRLPIVGRVSMDSTIIDISDLPEGTLKLGSTVEFLGPHQSLEDVAECAGTISWEVLTSIGQRYHRTYL

SEQ ID NO: 347 - DNA, 1113 bp, Unknown
  Obtained from environmental sample
atgtcgcattccaccacctgggaaaaggccggcgcgcccggcatcctcaccatcgatctctcggccctcgcgcgcaattaccggcgcgtggcgacaaccgtcgccccggcaagggcggccgccgtcgtcaaggcggatgcctatggattgggcgcgcagacggttgccccggcgctttacgcggagggatgccgggatttcttcgtggcgcaatatgccgaggccgtgacgcttcgtccgctcctgccgcgcgatgccgcgctttacgtgttgaacggcctgcagccgggcatcgaaggtgattgcgccgcacgtgacatcatccccgtcctgaattcgctggaacaggtggtgcgctggcgcacgacggccgaactttctggccgcccgctgaaggcactgctgcagtttgataccggcatgtcgcgtctcggcatggcgactgaggaggccgaagcgcttgccgccgatccgacgcttctctccggcattgagatcctctacgtcatgagccacctcgcctgcgctgacgaggcggaagatccgcataatgctgatcaggccgagatgatgcgccggttttccagcagttttccgggcattcccgtctgtttcggcaattccgccggtgcttttctgggtgaaagctttcgcggtgctctggtgcgtcccggcattgccctttacggcgcacgtcccaccgatattctcgaacggccgatggagccggtggtgaagatcgaggcgcgcgtcatccagacgcgcaccgtgctatcaggcaccgccatcggctattcggcaacctatgtgaccgacagcgaacggcaattggccaccgtggcgctcggttatgcggacgggttgccgcgcgcgctcagcaatcgcggcgcgctttatttcaggggtcatcgccttcccattctcgggcgggtgtcgatggacagcaccatcatcgacatcagtgacctcgagccgggcacgctgacgcttggcagccttgtcgaattcatcggggaacaccagacgctggaagacgtggcggaaaccgccggcaccatttcctgggagatcctcaccggcatcggccatcgctactttcgccagtatcgctga

SEQ ID NO: 348 - protein, 370 aa, Unknown
  Obtained from environmental sample
  DOMAIN (13)...(234): Alanine racemase, N-terminal domain
  DOMAIN (244)...(370): Alanine racemase, C-terminal domain
  SITE (41)...(51): Alanine racemase pyridoxal-phosphate attachment site. Prosite id = PS00395
MSHSTTWEKAGAPGILTIDLSALARNYRRVATTVAPARAAAVVKADAYGLGAQTVAPALYAEGCRDFFVAQYAEAVTLRPLLPRDAALYVLNGLQPGIEGDCAARDIIPVLNSLEQVVRWRTTAELSGRPLKALLQFDTGMSRLGMATEEAEALAADPTLLSGIEILYVMSHLACADEAEDPHNADQAEMMRRFSSSFPGIPVCFGNSAGAFLGESFRGALVRPGIALYGARPTDILERPMEPVVKIEARVIQTRTVLSGTAIGYSATYVTDSERQLATVALGYADGLPRALSNRGALYFRGHRLPILGRVSMDSTIIDISDLEPGTLTLGSLVEFIGEHQTLEDVAETAGTISWEILTGIGHRYFRQYR

SEQ ID NO: 349 - DNA, 993 bp, Unknown
  Obtained from environmental sample
atgaccgggctgacggtaacggcggtgaccgaggattggtcgctgcgggttccgttccggatttcccgggagaccatgacccatgccacggttgtgattgtcgaagtgacggacggtgtcgcgacgggtcggggtgagggatgtcctgtcccccattacggcgagagtgtcgaaggggttctcgaccagatccgggttatggcggccgctctggcggctggcgaggactgggacgcggtgcatgaacgcaccccggcgggttcggcgcgcaacgcggttgactgcgcggtctgggactggcgggcgaagcgggcgggcaggcctgtttcggatctgctgggcatggcagcgttgaggccggttgagaccgtgttcacccttggtcttgatgagccggaggtgatggcgctgaacgcgaagaaggcgtcggcccacgatattctcaaactcaagattggcggcgatgtggccgcggacatggcccgcctgcgcgccgtgcgcgatgcggtgcccgacaagcggctgatcgcggacgtgaacgaaggctggagccttgccgatcttgatgccgccatgccgttggttgccgactgtggccttctcatgctggaacagcccttgcccgcaggcaaggatgatgggctcaggggcgctgactatccggtgcctatcggcgctgacgagtcctgtcacaccaccgccgaccttgaccgggtcgcggaacgttacggcgtcatcaacatcaagctcgacaagaccggcgggctgaccgaagccatgcggctggtgcgtggcgggcaggaacgcgggctcggcatcatgattggctgcatgctgggcacctcgcttgccatggcgccgggtgtgatcgtggcccagttcgcccgctttgtggatctggacgcgcccctgctgatcggggccgaccgggatccggcgctgacctacgacaatggcattatccggccgccatcccccggactctggggatga

SEQ ID NO: 350 - protein, 330 aa, Unknown
  Obtained from environmental sample
  DOMAIN (3)...(114): Mandelate racemase / muconate lactonizing enzyme, N-terminal domain
  DOMAIN (132)...(223): Mandelate racemase / muconate lactonizing enzyme, C-terminal domain
MTGLTVTAVTEDWSLRVPFRISRETMTHATVVIVEVTDGVATGRGEGCPVPHYGESVEGVLDQIRVMAAALAAGEDWDAVHERTPAGSARNAVDCAVWDWRAKRAGRPVSDLLGMAALRPVETVFTLGLDEPEVMALNAKKASAHDILKLKIGGDVAADMARLRAVRDAVPDKRLIADVNEGWSLADLDAAMPLVADCGLLMLEQPLPAGKDDGLRGADYPVPIGADESCHTTADLDRVAERYGVINIKLDKTGGLTEAMRLVRGGQERGLGIMIGCMLGTSLAMAPGVIVAQFARFVDLDAPLLIGADRDPALTYDNGIIRPPSPGLWG

SEQ ID NO: 351 - DNA, 1005 bp, Unknown
  Obtained from environmental sample
atgagcacgcgtctgagtgtgacggtcgaacggtggccgctgaagaatccgttccggatcacgaatcacacgttcgtgaatctggacgcggtggtcgtgcggctcgagcgcgacggctgcgtggggttcggagaagccgccggggtttactacaagaaagacgacgccgcgcgcatcgtcccgctcatcgaatcgaaacgttccgccatcgaagccgacatcgatcgcgaggcgctgcgggaaatccttcccgctggcggcgcgcgcaatgccgtcgactgcgcgctctgggatctggaggccaaactccaacgcaaacccgcatggcagatcgcgggactcacggcgttgaggccgttgctcacgacattcacctgcggcgcgaatccgcccgacgtcatggcgaagactgcgcggagttacaccggcgcgcgcgccatcaaactgaagctcaccggcgaaccggaagatgccgagcgcgttcgcgccgtacgccgcgcctgccctgacgtctggctcggcgtcgacgccaaccagggattcactcgttcatctctcgaagcgctgctgcccgtgctgatcgaggcagacgtacaactcatcgaacagcctttccccgtcggccgcgaagccgagctggacggtctcgattcgcccatcgcgctcgccgccgacgaaagtatccaggattcggccgacgtcgccgccctcgccgaccgcttcgacgtcgtgaacatcaagctcgacaagtgtggcgggctcaccgaagccttcgccatcgcgcaacaggctcggcgctacgggctcgacgtcatggtggggaacatgacagggacggcgctcgccgtcgcaccggccatgctgatcgggcagctctgcaaggtggtcgatctcgatagcgccatttttctcagtgacgatcgcaagcccggcactgtgtacgaaaacggcacggtgtggtgctcgcccgccgtctggggttctgcggagcgtggcgcgcagtga

SEQ ID NO: 352 - protein, 334 aa, Unknown
  Obtained from environmental sample
  DOMAIN (2)...(113): Mandelate racemase / muconate lactonizing enzyme, N-terminal domain
  DOMAIN (131)...(223): Mandelate racemase / muconate lactonizing enzyme, C-terminal domain
  SITE (22)...(25): N-glycosylation site. Prosite id = PS00001
  SITE (279)...(282): N-glycosylation site. Prosite id = PS00001
  SITE (320)...(323): N-glycosylation site. Prosite id = PS00001
MSTRLSVTVERWPLKNPFRITNHTFVNLDAVVVRLERDGCVGFGEAAGVYYKKDDAARIVPLIESKRSAIEADIDREALREILPAGGARNAVDCALWDLEAKLQRKPAWQIAGLTALRPLLTTFTCGANPPDVMAKTARSYTGARAIKLKLTGEPEDAERVRAVRRACPDVWLGVDANQGFTRSSLEALLPVLIEADVQLIEQPFPVGREAELDGLDSPIALAADESIQDSADVAALADRFDVVNIKLDKCGGLTEAFAIAQQARRYGLDVMVGNMTGTALAVAPAMLIGQLCKVVDLDSAIFLSDDRKPGTVYENGTVWCSPAVWGSAERGAQ

SEQ ID NO: 353 - DNA, 381 bp, Unknown
  Obtained from environmental sample
aaagaattcggcacgagctcgcgcatccggcaagcggtgaacgaaaccggtttccgcgacgtcgaccatgtcgagctcttcggcccgggcacgaaaccgggcgcgagcagccgcagtttcgtgctttgccccggcaacgcctacgatcgttcgccctgcggcacgggcaccagcgcgaagctggcgtgcctcgccgccgacgggaaactggcgccgggcgtcgagtgggtgcaggagagcatcgtcggcagcacgttcaaggcgaagtaccgccgccaaggcgacaaaatcgtcccgacgatcaccggccacgcctatgtgatggccgagtcgacgctgcggctcgcgccgaacgatccgttcgcgtgggggattcgatga

SEQ ID NO: 354 - protein, 126 aa, Unknown
  Obtained from environmental sample
  DOMAIN (1)...(126): Proline racemase
  SITE (14)...(17): N-glycosylation site. Prosite id = PS00001
KEFGTSSRIRQAVNETGFRDVDHVELFGPGTKPGASSRSFVLCPGNAYDRSPCGTGTSAKLACLAADGKLAPGVEWVQESIVGSTFKAKYRRQGDKIVPTITGHAYVMAESTLRLAPNDPFAWGIR

SEQ ID NO: 355 - DNA, 1155 bp, Unknown
  Obtained from environmental sample
atgcaaacgaaacccgcgccccgatccgtccgttccgctcccgccgaagccggccgaagggtctggctggagattcgcctttcctccatccgtgaaaattttctccgcatccagaagacggtgaagcccgcgcaggtgatggccgtgctcaaggccgatgcttacggcctgggcctcctgcccatcgccaaaaccctggcggaggcgggcgtgtcgcgcttcggcgtggcggggctgcgcgaagccgcgctgctgcggaagcacgtgtcgcaacccgttcacatcctgagcgccctgctggagggagaggttgccgaggcggttcgcctgggaatccggtgtcccgttcccgatctgcaaacggcccgctggctgtcggcggaagcggtgcgccaaaaggaaaacgtcacggttcacatcaaggtcgatacgggcatgggacggctcggcatcccgcatttcgaggcggcgaaaaccgttgcgcgcatcgtgaagctcccgggtttgaaggtcgaggggatcttctcccatttggccgacgccaaccatccgcagcatgccaagacgcgccagcaaatctcttttttccgtcgcgtgctcgacgaattgaaatcgcgcggcatggagtttcccatggcgcatctcgccaattcggacggcatcaacaactttcccgacgcgtatttcgatctggtgcggaccggcatcaatctttatggcgtcttcgatctgctgggtttccgggcctacaagctttcgccctcgctcgccctgaagagccgcctgctggcgcgccgcaaactcccggcaggctacaccgtcgggtacggcggcacccacacgctgtttcgcgacgcgtggatcggaaccattcccgcggggtatgccgacggcgttccgctggcagccagcaattccggctttgtcttaatccgcggcaaagcatgccccatcgtgggacgcgtctccatggattacctgactgtcgatttgacggcgtgtccgcaggcccgggtgggggacgaggtggtgctggtgggccgatccggaaaccaggaacagacgatcgaagactgggcgcgcatcaagcaaacccacccttacgacatcatttgctcgctggggccgcgcgtggaacgggtttacattcgctaa

SEQ ID NO: 356 - protein, 384 aa, Unknown
  Obtained from environmental sample
  DOMAIN (20)...(244): Alanine racemase, N-terminal domain
  DOMAIN (255)...(383): Alanine racemase, C-terminal domain
  SITE (48)...(58): Alanine racemase pyridoxal-phosphate attachment site. Prosite id = PS00395
  SITE (137)...(140): N-glycosylation site. Prosite id = PS00001
MQTKPAPRSVRSAPAEAGRRVWLEIRLSSIRENFLRIQKTVKPAQVMAVLKADAYGLGLLPIAKTLAEAGVSRFGVAGLREAALLRKHVSQPVHILSALLEGEVAEAVRLGIRCPVPDLQTARWLSAEAVRQKENVTVHIKVDTGMGRLGIPHFEAAKTVARIVKLPGLKVEGIFSHLADANHPQHAKTRQQISFFRRVLDELKSRGMEFPMAHLANSDGINNFPDAYFDLVRTGINLYGVFDLLGFRAYKLSPSLALKSRLLARRKLPAGYTVGYGGTHTLFRDAWIGTIPAGYADGVPLAASNSGFVLIRGKACPIVGRVSMDYLTVDLTACPQARVGDEVVLVGRSGNQEQTIEDWARIKQTHPYDIICSLGPRVERVYIR

SEQ ID NO: 357 - DNA, 1203 bp, Unknown
  Obtained from environmental sample
atggaacgaatcgtccagaagctgctcgcccaacctcaacgtgatggaggccaactggtccggcaggaagccggctggcagaaggcccgccctcgccaaccggcacgccctacctgggtcgaaattgacctggaggcgctggccagtaatgtgcaactgctggctaaaacggcagccccggccaaaattatggccgttctcaaggcggatgcttacggccacgggatggttaaagttgcccgaacggctctgaacaacggagccagttggctgggggttgccaccctgggagaagcgatcagcctgcgccggggtgggattgatgagcctattctggtactgagttatatgccggcctggcaagctcatgaggctatcaattataacatcagcgcgactattttcagtcaggagatcgccagggcttttagccgggcggctcttgatttgaacaaagcgggccacattcaaataaaggtcgatacgggtatgggacggctggggctcctccctcatgaggtgctgccctttatgagctatttaagacaaaccgacctaaaagtagaagggttatacactcacttcgcgacagccgatgaggccgacctgactcacgcacacaaacagttgagctgttttcagatattgttaaaacagttagacgaagccggcctccgccctcctctaatccatgcggcgaatacggccggattactcaagttgccggaagcgcgctttgacatggttcgctcagggattgggctctatggtctacggccctccgagacggtgtcgctgccggaaggtttccggccggtgttaacctttaaaagtaccgtggggcaagttaaaaccttacctcccggcagtccggtgggatatggggccacgtactacacccaaggtaaagaaacgattgcgatcattccggtgggctacgccgatggcttccggcgggacccctatacctggaaagaggttctggtgaaagggcagcgggcccccctcattggccgggtgagcatggatcagtgcgccattaatgtgtcgcacattcctcaagtgaggcaaggagatgaggtggtcctaatcgggcagcagggccaggaaatcattaccgctgaggaggttgcagccaatttagggacggttaattatgaggtggtgagcgctttgatggcacggattccgcggatgtcataa

SEQ ID NO: 358 - protein, 400 aa, Unknown
  Obtained from environmental sample
  DOMAIN (37)...(261): Alanine racemase, N-terminal domain
  DOMAIN (273)...(399): Alanine racemase, C-terminal domain
  SITE (353)...(356): N-glycosylation site. Prosite id = PS00001
MERIVQKLLAQPQRDGGQLVRQEAGWQKARPRQPARPTWVEIDLEALASNVQLLAKTAAPAKIMAVLKADAYGHGMVKVARTALNNGASWLGVATLGEAISLRRGGIDEPILVLSYMPAWQAHEAINYNISATIFSQEIARAFSRAALDLNKAGHIQIKVDTGMGRLGLLPHEVLPFMSYLRQTDLKVEGLYTHFATADEADLTHAHKQLSCFQILLKQLDEAGLRPPLIHAANTAGLLKLPEARFDMVRSGIGLYGLRPSETVSLPEGFRPVLTFKSTVGQVKTLPPGSPVGYGATYYTQGKETIAIIPVGYADGFRRDPYTWKEVLVKGQRAPLIGRVSMDQCAINVSHIPQVRQGDEVVLIGQQGQEIITAEEVAANLGTVNYEVVSALMARIPRMS

SEQ ID NO: 359 - DNA, 1203 bp, Unknown
  Obtained from environmental sample
atggaacgaatcgtccagaagctgctcgcccaacctcaacgtgatggaggccaactggtccggcaggaagccggctggcagaaggcccgccctcgccaaccggctcgccccacctgggtcgaaattgacctggaggcgctggccagtaatgtgcaactgctggctaaaacggcagccccggccaaaattatggccgttctcaaggcagatgcttacggccacgggatggttaaagttgcccgaacggctctgaacaacggagccagttggctgggggttgccaccctgggagaagcgatcagcctgcgccggagtggaattgatgagcctattctggtactgagttatatgccggcctggcaagctcatgaggctatcaattataacatcagcgcgactatcttcagtcaggagatcgccagggcttttagccgggcggctcttgatttgaacaaagcgggccacattcaaataaaggtcgatacgggtatgggacggctggggctcctccctcatgaggtgctgccctttatgagctatttaagacaaaccgacctaaaagtagaagggttatacactcacttcgcgacagccgatgaggccgacctgactcacgcacacaaacagttgagctgttttcagacattgttaaaacagttagacgaagccggcctccgccctcctctaatccatgcggcgaatacggccggattactcaaattgccggaagcgcgctttgatatggttcgctcagggattggactctatggtctacggccctccgagacggtgtcgctgccggaaggtttccggccggtgttaacctttaaaagtaccgtggggcaagttaaaaccttacctcccggcagtccggtgggatatggggccacgtactacacccaaggtaaagaaacgattgcgatcattccggtgggctacgccgatggcttccggcgggacccctatacctggaaagaggtcctggtgaaagggcagcgggcccccctcattggccgggtgagcatggatcagtgcgccattaatgtgtcgcacattcctcaagtgaggcaaggagatgaggtggtcctgatcgggcagcagggccaggaaatcattaccgctgaggaggttgcagccaatttagggacggttaattatgaggtggtgagcgctttgatggcacggattccgcggatgtcataa

SEQ ID NO: 360 - protein, 400 aa, Unknown
  Obtained from environmental sample
  DOMAIN (37)...(261): Alanine racemase, N-terminal domain
  DOMAIN (273)...(399): Alanine racemase, C-terminal domain
  SITE (353)...(356): N-glycosylation site. Prosite id = PS00001
MERIVQKLLAQPQRDGGQLVRQEAGWQKARPRQPARPTWVEIDLEALASNVQLLAKTAAPAKIMAVLKADAYGHGMVKVARTALNNGASWLGVATLGEAISLRRSGIDEPILVLSYMPAWQAHEAINYNISATIFSQEIARAFSRAALDLNKAGHIQIKVDTGMGRLGLLPHEVLPFMSYLRQTDLKVEGLYTHFATADEADLTHAHKQLSCFQTLLKQLDEAGLRPPLIHAANTAGLLKLPEARFDMVRSGIGLYGLRPSETVSLPEGFRPVLTFKSTVGQVKTLPPGSPVGYGATYYTQGKETIAIIPVGYADGFRRDPYTWKEVLVKGQRAPLIGRVSMDQCAINVSHIPQVRQGDEVVLIGQQGQEIITAEEVAANLGTVNYEVVSALMARIPRMS

SEQ ID NO: 361 - DNA, 1203 bp, Unknown
  Obtained from environmental sample
atggaacgaatcgtccagaagctgctcgcccaacctcaacgtgatggaggccaactggtccggcaggaagccggctggcagaaggcccgccctcgccaaccggctcgccccacctgggtcgaaattgacctggaggcgctggccagtaatgtgcaactgctggctaaaacggcagccccggccaaaattatggccgttctcaaggcggatgcttacggccacgggatggttaaagttgcccgaacggctctgaacaacggagccagttggctgggggttgccaccctgggagaagcgattagcctgcgccggggtgggattgatgagcctattctggtactgagttatatgccggcctggcaagctcatgaggctatcaattataacatcagcgcgactattttcagtcaggagatcgccagggcttttagccgggcggctcttgatttgaacaaagcgggccacattcaaataaaggtcgatacgggtatgggacggctggggctcctccctcatgaggtgctgccctttatgagctatttaagacaaaccgacctaaaagtagaagggttatacactcacttcgcgacagccgatgaggccgacctgactcacgcacacaaacagttgagctgttttcagatattgttaaaacagttagacgaagccggcctccgccctcctctaatccatgcggcgaatacggccggattactcaagttgccggaagcccgctttgatatggttcgctcagggattgggctctatggtctacggccctccgagacggtgtcgctgccggaaggtttccggccggtgttaacctttaaaagtaccgtggggcaagttaaaaccttacctcccggcagtccggtgggatatggggccacgtactacacccaaggtaaagaaacgattgcgatcattccggtgggctacgccgatggcttccggcgggacccccatacctggaaagaggttctggtgaaagggcagcgggcccccctcgttggccgggtgagcatggatcagtgcgccattaatgtgtcgcacattcctcaagtgaggcaaggagatgaggtggtcctgatcgggcagcagggccaggaaatcattaccgctgaggaggttgcagccaatttagggacggttaattatgaggtggtgagcgctttgatggcacggattccgcggatgtcataa

SEQ ID NO: 362 - protein, 400 aa, Unknown
  Obtained from environmental sample
  DOMAIN (37)...(261): Alanine racemase, N-terminal domain
  DOMAIN (273)...(399): Alanine racemase, C-terminal domain
  SITE (353)...(356): N-glycosylation site. Prosite id = PS00001
MERIVQKLLAQPQRDGGQLVRQEAGWQKARPRQPARPTWVEIDLEALASNVQLLAKTAAPAKIMAVLKADAYGHGMVKVARTALNNGASWLGVATLGEAISLRRGGIDEPILVLSYMPAWQAHEAINYNISATIFSQEIARAFSRAALDLNKAGHIQIKVDTGMGRLGLLPHEVLPFMSYLRQTDLKVEGLYTHFATADEADLTHAHKQLSCFQILLKQLDEAGLRPPLIHAANTAGLLKLPEARFDMVRSGIGLYGLRPSETVSLPEGFRPVLTFKSTVGQVKTLPPGSPVGYGATYYTQGKETIAIIPVGYADGFRRDPHTWKEVLVKGQRAPLVGRVSMDQCAINVSHIPQVRQGDEVVLIGQQGQEIITAEEVAANLGTVNYEVVSALMARIPRMS

SEQ ID NO: 363 - DNA, 1203 bp, Unknown
  Obtained from environmental sample
atggaacgaatcgtccagaagctgctcgcccaacctcaacgtgatggaggccaactggtccggcaggaagccggctggcagaaggcccgccctcgccaaccggctcgccccacctgggtcgaaattgacctggaggcgctggccagtaatgtgcaactgctggctaaaacggcagccccggccaaaattatggccgttctcaaggcagatgcttacggccacgggatggttaaagttgcccgaacggctctgaacaacggaggcagttggctgggggttgccaccctgggagaagcgatcagcctgcgccggagtggaattgatgagcctattctggtactgagttatatgccggcctggcaagctcatgaggctatcaattataacatcagcgcgactattttcagtcaggagatcgccagggcttttagccgggcggctcttgatttgaacaaagcgggccacattcaaataaaggtcgatacgggtatgggacggctggggctcctccctcatgaggtgctgccctttatgagctatttaagacaaactgacctaaaagtagaagggttatacactcacttcgcgacagccgatgaggccgacctgactcacgcacacaaacagttgagctgttttcagacattgttaaaacagttagacgaagccggcctccgccctcctctaatccatgcggcgaatacggccggattactcaaattgccggaagcgcgctttgatatggttcgctcagggattggactctatggtctacggccctccgagacggtgtcgttgccggaagatttccggccggtgttaacctttaaaagtaccgtggggcaagttaaaaccttacctcccggcagtccggtgggatatggggccacgtactacacccaaggtaaagaaacgattgcgatcattccggtgggctacgccgatggcttccggcgggacccctatacctggaaagaggttctggtgaaagggcagcgggcccccctcattggccgggtgagcatggatcagtgcgccattaatgtgtcgcacattcctcaagtgaggcaaggagatgaggtggtcctgatcgggcagcagggccaggaaatcattaccgctgaggaggttgcagccaatttagggacggttaattatgaggtggtgagcgctttgatggcacggattccgcggatgtcataa

SEQ ID NO: 364 - protein, 400 aa, Unknown
  Obtained from environmental sample
  DOMAIN (37)...(261): Alanine racemase, N-terminal domain
  DOMAIN (273)...(399): Alanine racemase, C-terminal domain
  SITE (353)...(356): N-glycosylation site. Prosite id = PS00001
MERIVQKLLAQPQRDGGQLVRQEAGWQKARPRQPARPTWVEIDLEALASNVQLLAKTAAPAKIMAVLKADAYGHGMVKVARTALNNGGSWLGVATLGEAISLRRSGIDEPILVLSYMPAWQAHEAINYNISATIFSQEIARAFSRAALDLNKAGHIQIKVDTGMGRLGLLPHEVLPFMSYLRQTDLKVEGLYTHFATADEADLTHAHKQLSCFQTLLKQLDEAGLRPPLIHAANTAGLLKLPEARFDMVRSGIGLYGLRPSETVSLPEDFRPVLTFKSTVGQVKTLPPGSPVGYGATYYTQGKETIAIIPVGYADGFRRDPYTWKEVLVKGQRAPLIGRVSMDQCAINVSHIPQVRQGDEVVLIGQQGQEIITAEEVAANLGTVNYEVVSALMARIPRMS

SEQ ID NO: 365 - DNA, 1203 bp, Unknown
  Obtained from environmental sample
atggaacgaatcgtccagaagctgctcgcccaacctcaacgtgatggaggccaactggtccggcaggaagccggctggcagaaggcccgccctcgccaaccggctcgccccacctgggtcgaaattgacctggaggcgctggccagtaatgtgcagctgctggctaaaacggcagccccggccaaaattatggccgttctcaaggcagatgcttacggccacgggatggttaaagttgcccgaacggctctgaacaacggagccagttggctgggggttgccaccctgggagaagcgatcagcctgcgccggagtggaattgatgagcctattctggtactgagttatatgccggcctggcaagctcatgaggctatcaattataacatcagcgcgactattttcagtcaggagatcgccagggcttttagccgggcggctcttgatttgaacaaagcgggccgcattcaaataaaggtcgatacgggtatgggacggctggggctcctccctcatgaggtgctgccctttatgagctatttaagacaaaccgacctaaaagtagaagggttatacactcacttcgcgacagccgatgaggccgacctgactcacgcacacaaacagttgagctgttttcagacattgttaaaacagttagacgaagccggcctccgccctcctctaatccatgcggcgaatacggccggattactcaaattgccggaagcgcgctttgatatggttcgctcagggattggactctatggtctacggccctccgagacggtgtcgctgccggaaggtttccggccggtgttaacctttaaaagtaccgtggggcaagttaaaaccttacctcccggcagtccggtgggatatggggccacgtactacacccaaggtaaagaaacgattgcgatcattccggtgggctacgccgatggcttccggcgggacccctatacctggaaggaggttctggtgaaagggcagcgggcccccctcattggccgggtgagcatggatcagtgcgccattaatgtgtcgcacattcctcaagtgaggcaaggagatgaggtggtcctgatcgggcagcagggccaggaaatcattaccgctgaggaggttgcagccaatttagggacggttaattatgaggtggtgagcgctttgatggcacggattccgcggatgtcataa

SEQ ID NO: 366 - protein, 400 aa, Unknown
  Obtained from environmental sample
  DOMAIN (37)...(261): Alanine racemase, N-terminal domain
  DOMAIN (273)...(399): Alanine racemase, C-terminal domain
  SITE (353)...(356): N-glycosylation site. Prosite id = PS00001
MERIVQKLLAQPQRDGGQLVRQEAGWQKARPRQPARPTWVEIDLEALASNVQLLAKTAAPAKIMAVLKADAYGHGMVKVARTALNNGASWLGVATLGEAISLRRSGIDEPILVLSYMPAWQAHEAINYNISATIFSQEIARAFSRAALDLNKAGRIQIKVDTGMGRLGLLPHEVLPFMSYLRQTDLKVEGLYTHFATADEADLTHAHKQLSCFQTLLKQLDEAGLRPPLIHAANTAGLLKLPEARFDMVRSGIGLYGLRPSETVSLPEGFRPVLTFKSTVGQVKTLPPGSPVGYGATYYTQGKETIAIIPVGYADGFRRDPYTWKEVLVKGQRAPLIGRVSMDQCAINVSHIPQVRQGDEVVLIGQQGQEIITAEEVAANLGTVNYEVVSALMARIPRMS

SEQ ID NO: 367 - DNA, 1074 bp, Pseudomonas straminea ATCC 33636
atgcgtcccgcccgtgccctgatcgacctgcaagccctgcgtcacaattaccaactggcccgtgaactggctggcgcccgctcgctggcagtggtcaaggccgatgcctatgggcatggcgcggtacgttgcgcccaggcgctgcaggcggatgccgacggcttcgccgtggcctgtatcgaagaagcgctgcagctgcgcgccgagggcatcagcgcgccgatcctgttgcttgaaggcttcttcgaggccagcgagctggcgctgatcgacgagcatgacctgtggtgcgtggtgcacgccgggtggcagttggaagccatcgagcaggcggacctgaagcgcccgctgaacgtctggctcaagctggacagcggcatgcatcgcgtcggtttccacccggccgactatcaggccgcctaccggcgcctgctggccagcggcaaggtggtgaagatcgtgctgatgagccacttctcccgcgccgacgagctcgactgcccgcgcagtaatgaacaactggcggtgtttcagcaggcccgcgaaggccttgccgccgaggtcagcctgcgcaattcgccggccctgctgggctggccgagtatccccagtgactggtcgcggcccggcatcatgctctacggcgccacgccgttcgagcggacccaggacgtcgccgcccggctgcagccggtgatgaccctggagtcgcgcgtcatcagcgtgcgtgacctgccggccggcgagccggtcggctacggcgcgcgtttcgtcagcgagcgtgccacccgtgtcggtgtggtcgccatgggttacgccgacggttatccgcgtcacgcgccgaccggcaccccggtgctgatcgacggccagccctcgcggatcatcggtcgtgtttccatggacatgctcaccgtcgacctcagtgacctgccgggcgctggcctgggcagccgcgtcgagttctgggggcgcggcgtgctggccagcgacgtcgccctggccgccggcaccattccctatcagctgttctgcaatgtgcggcgggtgccgctgatctacagcgaagcctag

SEQ ID NO: 368 - protein, 357 aa, Pseudomonas straminea ATCC 33636
  DOMAIN (3)...(219): Alanine racemase, N-terminal domain
  DOMAIN (232)...(355): Alanine racemase, C-terminal domain
  SITE (30)...(40): Alanine racemase pyridoxal-phosphate attachment site. Prosite id = PS00395
MRPARALIDLQALRHNYQLARELAGARSLAVVKADAYGHGAVRCAQALQADADGFAVACIEEALQLRAEGISAPILLLEGFFEASELALIDEHDLWCVVHAGWQLEAIEQADLKRPLNVWLKLDSGMHRVGFHPADYQAAYRRLLASGKVVKIVLMSHFSRADELDCPRSNEQLAVFQQAREGLAAEVSLRNSPALLGWPSIPSDWSRPGIMLYGATPFERTQDVAARLQPVMTLESRVISVRDLPAGEPVGYGARFVSERATRVGVVAMGYADGYPRHAPTGTPVLIDGQPSRIIGRVSMDMLTVDLSDLPGAGLGSRVEFWGRGVLASDVALAAGTIPYQLFCNVRRVPLIYSEA

SEQ ID NO: 369 - DNA, 861 bp, Unknown
  Obtained from environmental sample
atggaagtgcattttagaaaatatcatggactgggaaacgattatcttgttattgatccgaacgtttacgatgtggatttaacgccggatacaattcgcttgatttgcgacagaaactttggaatcgggtctgatgggattctgtacggcccaatcaaaaaagggaacactttgagtgtgaggatattcaatccagatggtagcgaggccgagaaaagcggtaacggattgagaatattcgcgaaatacttatttgagaataagtacgtaaataagaagcatttcagcatcgaaacatcaggtggaattgtcgaagcgcatattaaagatgactcggcaaatatgattaagattaacatggggaaggtgaccttcaccagtactgaaatcccggtcagaggtgaagaaagagaggtagtcaatgaagaactgcaaataaatctaaacaaatataaagtgacctgcctgtctataggcaatcctcattgtgtgattccaatggacgaggtgactgaagaaaaggcaaaagaattagggcctaaagtagagaatcatgatatgtttccgaatagaatcaacatgcagctcctgaaagttgtcgacaggtcaaatatcgagataaggatttgggaaagaggtgccggctacaccttagcttccggcagtagttcctgcgcggcggctggggcggcatataaattaaaaatggtggacaacaaaatcaatgtgaaaatgccgggaggtaagttattaatcgaaatcagcaagagtgaagatgtgtatatgaccggggcggttgagggagctttcgagggttgttttcattccgacttaaaagagaagattttaagaatgaagtga

SEQ ID NO: 370 - protein, 286 aa, Unknown
  Obtained from environmental sample
  DOMAIN (5)...(126): Diaminopimelate epimerase
  DOMAIN (154)...(269): Diaminopimelate epimerase
MEVHFRKYHGLGNDYLVIDPNVYDVDLTPDTIRLICDRNFGIGSDGILYGPIKKGNTLSVRIFNPDGSEAEKSGNGLRIFAKYLFENKYVNKKHFSIETSGGIVEAHIKDDSANMIKINMGKVTFTSTEIPVRGEEREVVNEELQINLNKYKVTCLSIGNPHCVIPMDEVTEEKAKELGPKVENHDMFPNRINMQLLKVVDRSNIEIRIWERGAGYTLASGSSSCAAAGAAYKLKMVDNKINVKMPGGKLLIEISKSEDVYMTGAVEGAFEGCFHSDLKEKILRMK

SEQ ID NO: 371 - DNA, 813 bp, Unknown
  Obtained from environmental sample
ttgagcttctacaagctgagtggcagtggcaacgacttcgtcctgatcgatgatcgggacaggcggctcgatgtcgacccggcgtggctcgccgcgcggctgtgccggcggggcatctccgtgggcgccgacgggctgatcctggtcgagccgtccccgcaggccgacttccgcatgcgcatcttcaacgcggacggcagcgaggccgagatgtgcggcaacggcgcgcgttgcgttgcacggtttgccgagatcgtggggattgcgggtcctcggatggccattgagacgatggcgggcgtgatccgggccgaggtgagcggatcgagcgtcaagctccagacaagcgcgcctcgagatctcaggctccggcggtcgatcgaggtggacggggtcctccaccaggtgcacagcatcaacacgggtgtcccgcacgccgtgctcttctgcacggatctggaggaggtgccggtaaaggagctcggacgtcagatccggtttcacctggcatttcagcctgcgggtaccaacgtggattttgtcgccgtcggggacggtgccggcctcgccgtgcgaacgtacgagcgcggggtagaggacgagacgctggcgtgcgggacgggcgtcgtggcgtcggccctggtggcgtcggccctggggttggcgtcgtctcccgtccacgtgcgggtcagaagcggcgagacgctgacggtccacttcgacggtcgggggcaggacgcgcgcgaggtctacttcgaagggtcggttcgcgtcatctatcagggcgagctgatggagggtgcgctgacgtag

SEQ ID NO: 372 - protein, 270 aa, Unknown
  Obtained from environmental sample
  DOMAIN (3)...(121): Diaminopimelate epimerase
  DOMAIN (137)...(259): Diaminopimelate epimerase
MSFYKLSGSGNDFVLIDDRDRRLDVDPAWLAARLCRRGISVGADGLILVEPSPQADFRMRIFNADGSEAEMCGNGARCVARFAEIVGIAGPRMAIETMAGVIRAEVSGSSVKLQTSAPRDLRLRRSIEVDGVLHQVHSINTGVPHAVLFCTDLEEVPVKELGRQIRFHLAFQPAGTNVDFVAVGDGAGLAVRTYERGVEDETLACGTGVVASALVASALGLASSPVHVRVRSGETLTVHFDGRGQDAREVYFEGSVRVIYQGELMEGALT

SEQ ID NO: 373 - DNA, 873 bp, Unknown
  Obtained from environmental sample
atgatcccgttcaccaagggccacgggctcggcaacgactatctcgtctttcgggagagcgatctccccggtcccctgaccccgagcgccatcgtccggatctgcgatcgaaactggggcgtgggatcggacggcatcctgctcctcacgtcgtcgacccgggcggacttcggtctccggatcttcaaccccgacgggagcgaggccgagaagtccggcaacgggctccggatcttcgcgaagtacctctgggaccacggtatcgccaagcggacgagcttcagcgtcgagacgccgggcggcctcgtcgactgccagtgcgatgtccgggacgatcgcgtgcgcgcggtgacggtcgagatgggacgcgccaccttccgggcacgcgagatcccgatgaccgggcccgccgaggatgcggtggcggtggcgttgccgctgcccgatgggcgtggcctgacggtcaccgcggtctcggtggggaatccgcactgcgtggtcttcgtcgaccggctcgatgccgaggagtgccggcggaccggaccgctgatcgagcgccaccccgccttcccgaaccggacgaacgttcagttcgcccggcctcgatcgcgacacgaggtcgaaatcgagatctgggagcgcggcgcggggtacacggtggcctccggctcgtcgtcgtgcgccgcggcgtccgccgccgtcaggaacgggttctgcgaccacgggcgcgtcaccgtcgtcatgcccgggggcgagctcacgatcgaggtccggcccgactggtccctgcggctcgagggtccggtggaggaggtgtacacgggaaccctcagccgggagttcgaagaggcgtacgtgcgcgcccgaggatga

SEQ ID NO: 374 - protein, 290 aa, Unknown
  Obtained from environmental sample
  DOMAIN (4)...(127): Diaminopimelate epimerase
  DOMAIN (156)...(272): Diaminopimelate epimerase
  SITE (194)...(197): N-glycosylation site. Prosite id = PS00001
MIPFTKGHGLGNDYLVFRESDLPGPLTPSAIVRICDRNWGVGSDGILLLTSSTRADFGLRIFNPDGSEAEKSGNGLRIFAKYLWDHGIAKRTSFSVETPGGLVDCQCDVRDDRVRAVTVEMGRATFRAREIPMTGPAEDAVAVALPLPDGRGLTVTAVSVGNPHCVVFVDRLDAEECRRTGPLIERHPAFPNRTNVQFARPRSRHEVEIEIWERGAGYTVASGSSSCAAASAAVRNGFCDHGRVTVVMPGGELTIEVRPDWSLRLEGPVEEVYTGTLSREFEEAYVRARG

SEQ ID NO: 375 - DNA, 828 bp, Unknown
  Obtained from environmental sample
atgatccggttttggaagtatcaggcgatcggtaacgacttcccgctgttccacgcctccgacgtcgatggcatcgatcttggcgagcttgcgaaaagcgcggcggatcgcaatttcgggatcgggggtgatggaatcctcgtcatggatgctgtcgatcgtggaggggcccgtctacgcatgttcaatcccgacggcactgaggacttttgcgggaacggactccggatcgctgcccgccatgcttttgaccaaggatgggtggaccggcaattcaccttgatgcacggtggaaaggagatagcagcgctggtccgacaagacggcgtcattcttaccacgatcggcgtcgccgactacacgccgaacaaggtgcctgtacgcaaggaaagcgagttgttcgacggctctattgcggtgcttggcggcacggaattccggggtagcgccctcacaaccgggagcacccacaccgtgatccctgtgcaggaacttccctccgatgctgagattgccgagtgggggcccgagttggagcatcttccgatgttccctcagcgaacgagcgtgattttcgcccgcgaatcgcggcccatgagtctcgaaatccgcatttgggaacgaggcgtgggcgaaacctttggttgcggcacaggctcctctgcggccgcagcggattacctccgccgtctagatgcgtggggaacagtacttgtccgcaaccccggcggagacattcaggttcaaatggaccgttggagcgctcccatcactgtgtatggcgaggcctttctggtgtatcacggcgacttccaatttcccgtgtag

SEQ ID NO: 376 - protein, 275 aa, Unknown
  Obtained from environmental sample
  DOMAIN (4)...(121): Diaminopimelate epimerase
  DOMAIN (149)...(266): Diaminopimelate epimerase
MIRFWKYQAIGNDFPLFHASDVDGIDLGELAKSAADRNFGIGGDGILVMDAVDRGGARLRMFNPDGTEDFCGNGLRIAARHAFDQGWVDRQFTLMHGGKEIAALVRQDGVILTTIGVADYTPNKVPVRKESELFDGSIAVLGGTEFRGSALTTGSTHTVIPVQELPSDAEIAEWGPELEHLPMFPQRTSVIFARESRPMSLEIRIWERGVGETFGCGTGSSAAAADYLRRLDAWGTVLVRNPGGDIQVQMDRWSAPITVYGEAFLVYHGDFQFPV

SEQ ID NO: 377 - DNA, 1200 bp, Unknown
  Obtained from environmental sample
gtgaaaatcctcaccgtcatcggcaaccgaccccagttcatcaaggcagcggcggtctcgccgccgctgcgggacggggccgaagaggtgttggtgcacaccggccagcacttcgacgaccgcctctcggcgattttctttgccgagctcgggctgccggcgccggatatcgagctgcggatcgccggtggctcgaacacgtcgcagacggctcggatgctggccgcgctggagccggtcctggcggcgaacgagccggacgcggtgctcgtctacggcgacacgaactcgaccctggcgggggcgttggcggccgctggcgcgcagttgccggtggttcatgtcgaggccggcatgcgctcgtttgaccgggcgatgccggaggaacgtaaccgcgtgctgaccgaccatcttgcgagcctgctgctctgttccagcgaggcggcggcggcgaacctgcggcgtgaggggatcggcagcggagagctcacggggatggcaccgaccgcggtgggcgacgcccccgcggtgggcgacgacgcgacggtgggcgacgacgcgacggttcccctgcggctaaccgcggccgacagcggtccgcgagcccggatcgagaccgtcggcgacgtgatggttgacgtggcggtcgcggctcaggcacgcgcgcgtggtcgcgatgagatcgtgcgcgcgcacggcgtggcgccgggggagtacctgctggccacggcgcaccgggccgggaacgtcgatgaccctgtgcgcctgcaggcgctcgtcgagttgctcgccgggatcggatacccggtcgtactgccggtgcacccccgaactcgcgcccgcttgcgcgagttcgggctcgacggccggctggcggccgccgccgggatccagatctgcgagccgctcggctacctggagctctgcgccctgctgtgccacgcccgcgcggtgctgaccgactccggcggcctgcagaaggaggcttatctggccggcgtgccctgcctgacattgcgcgcgaacaccgagtggaccgagaccctggagcacggctggaacacactggtcgatcttgacatcgggcgggcgcgggcggcgctggccgcgccccggccgcgcgagcgcccacccctctacggcgatggtcgcgccggccggcgggtggtcgcggcgctgcaccgggcgctggcggcatag

SEQ ID NO: 378 - protein, 399 aa, Unknown
  Obtained from environmental sample
  DOMAIN (17)...(394): UDP-N-acetylglucosamine 2-epimerase
  SITE (67)...(70): N-glycosylation site. Prosite id = PS00001
  SITE (97)...(100): N-glycosylation site. Prosite id = PS00001
MKILTVIGNRPQFIKAAAVSPPLRDGAEEVLVHTGQHFDDRLSAIFFAELGLPAPDIELRIAGGSNTSQTARMLAALEPVLAANEPDAVLVYGDTNSTLAGALAAAGAQLPVVHVEAGMRSFDRAMPEERNRVLTDHLASLLLCSSEAAAANLRREGIGSGELTGMAPTAVGDAPAVGDDATVGDDATVPLRLTAADSGPRARIETVGDVMVDVAVAAQARARGRDEIVRAHGVAPGEYLLATAHRAGNVDDPVRLQALVELLAGIGYPVVLPVHPRTRARLREFGLDGRLAAAAGIQICEPLGYLELCALLCHARAVLTDSGGLQKEAYLAGVPCLTLRANTEWTETLEHGWNTLVDLDIGRARAALAAPRPRERPPLYGDGRAGRRVVAALHRALAA

SEQ ID NO: 379 - DNA, 879 bp, Unknown
  Obtained from environmental sample
atgactatcctggttactggcgccacaggcgctgtcggttcgcaagttgttcatcggctggtcgaggagggcgcaagcgtgcgggccatcgcacgttcgcccgaaaaagccaatctgccggcaagcgtcgacgtgcgcaaaggcgacatgacggatatcgcgtcgatgcgtgcggcgctcgaaggtgtcgacacgctgttcctgctcaacgcggtcgtcgccgacgaagtcacgcaggcgatcctcacgctgagcctcgcgcgcgatgccggcattcaacgcatcgtctatttctcggtgttcaattcagaccgcttcaccgacgttccccacttcacgggcaaatacacggtcgaacggatgatcgaggaattcgatttgccggctacgatcctgcgcccgagctatttcatccagaacgatgcatcgatgaaagaagtgatcgccggcaaatccatttatccgatgcccgtaggaagcgtcggcgtttcgatggccgacacccgcgacatcgcggaaatagccgccatcagtttgttgcagcgtgaacgttcggcgacgccgttgccacgcgaagtgatcgacgtggtcggtccgcaagccatgaccggcagcgcgttggccgcgatctggagcgaggttctgggcaagcccgtgaactacggcggcgatgatctcaatgcattcgaagcgcaaatggcgagccgtgcgccaagctggatggcacgcgacatccgcctgatgctcggccgtttccagcgcgacggcatggcggcaaatgagcgcgccgttgcacggatgaccgagttgctcgggcggccgccgcggtcgtatcgtgatttcgccgtcgagacggctaaggagtgggccgcgaagtaa

SEQ ID NO: 380 - protein, 292 aa, Unknown
  Obtained from environmental sample
  DOMAIN (1)...(115): short chain dehydrogenase
  DOMAIN (3)...(223): NmrA-like family
  DOMAIN (3)...(198): NAD dependent epimerase/dehydratase family
MTILVTGATGAVGSQVVHRLVEEGASVRAIARSPEKANLPASVDVRKGDMTDIASMRAALEGVDTLFLLNAVVADEVTQAILTLSLARDAGIQRIVYFSVFNSDRFTDVPHFTGKYTVERMIEEFDLPATILRPSYFIQNDASMKEVIAGKSIYPMPVGSVGVSMADTRDIAEIAAISLLQRERSATPLPREVIDVVGPQAMTGSALAAIWSEVLGKPVNYGGDDLNAFEAQMASRAPSWMARDIRLMLGRFQRDGMAANERAVARMTELLGRPPRSYRDFAVETAKEWAAK

SEQ ID NO: 381 - DNA, 879 bp, Unknown
  Obtained from environmental sample
atgactatcctggttactggcgccacgggcgctgtcggttcgcaagttgttcatcggctggtcgaggagggcgcaagcgtgcgggccatcgcacgttcgcccgaaaaagccaatctgccggcaagcgtcgatgtgcgcaaaggcgacatgacggatatcgcgtcgatgcgtgcggcgctcgaagatgtcgacacgctgttcctgctcaacgcggtcgtcgccgacgaagtcacgcaggcgatcctcacgctgagcctcgcgcgcgatgccggcattcaacgcatcgtctatttctcggtgttcaattcagaccgcttcaccgacgttccccacttcacgggcaaatacacggtcgaacggatgatcgaggaattcgatctgccggctacgatcctgcgcccgagctatttcatccagaacgatgcatcgatgaaagaagtgatcgccggcaaatcgatttatccgatgcccgtaggaagcgtcggcgtgtcgatggccgacacccgcgacatcgcggaaatagccgccatcagtttgttgcagcgtgaacgttcggcgacgccgttgccacgcgaagtgatcgacgtggtcggtccgcaagccatgaccggcagcgcgttggccgcgatctggaccgaggttctgggcaagcccgtgaactacggcggcgatgatctcgatgcattcgaagcgcaaatggcgagccgtgcgccaagctggatggcacgcgacatccgcctgatgctcggccgtttccagcgcgacggcatggcggcaaatgagcgcgccgttgcacggatgaccgagttgctcgggcggccgccgcggtcgtatcgtgatttcgccgtcgagacggctaaggagtgggccgcgaagtaa

SEQ ID NO: 382 - protein, 292 aa, Unknown
  Obtained from environmental sample
  DOMAIN (1)...(115): short chain dehydrogenase
  DOMAIN (3)...(223): NmrA-like family
  DOMAIN (3)...(198): NAD dependent epimerase/dehydratase family
MTILVTGATGAVGSQVVHRLVEEGASVRAIARSPEKANLPASVDVRKGDMTDIASMRAALEDVDTLFLLNAVVADEVTQAILTLSLARDAGIQRIVYFSVFNSDRFTDVPHFTGKYTVERMIEEFDLPATILRPSYFIQNDASMKEVIAGKSIYPMPVGSVGVSMADTRDIAEIAAISLLQRERSATPLPREVIDVVGPQAMTGSALAAIWTEVLGKPVNYGGDDLDAFEAQMASRAPSWMARDIRLMLGRFQRDGMAANERAVARMTELLGRPPRSYRDFAVETAKEWAAK

SEQ ID NO: 383 - DNA, 1071 bp, Unknown
  Obtained from environmental sample
atgaaaattaaagatatcaagtcgtggagtgttgaccttggaaacacgaagccctatacgatagcgttcaagaccatcgatgaggttaagaatgcctttgtcgaaattacgctggacaacggagttaccggcctcggctcgggcaatcccagtgaatatgttgtcggtgagagtttcgaacaatgcctggatgcgttacaagacaagaatctggactttctgatcggacgtgatatcagggagtttaatcagctgacgtacgatgtttggaagaagtttccagaaaatccttccgccagggcggcaatcgacatcgccctccacgacgcgttcaccaaattcctggatgttccgttggtgaaattcctgggacagaaaatcaaaaagctccctacgtcaaatacgatcgggataaagaacgtcgaagaaacggtcagagaagctgaagactacaagaaacgtggatttaaagtgatcaaggtgaagctcggcaaagacctcgatgaggatgttgagcggatcatgaaacttcgtgagaagctaggtaccggtatggtgatccgtgtagatgctaaccagggatacagtcgcgaacaaaccattcagttttatggaagatgctatgatctcgatattgaattgattgagcagcctcttcctgccaaggaaatagcggagatgaaatcgctcccgaaggaagtgcgtcaggtgctagcggctgacgagtcgctgatcaccccggccgacgcgctggaactgatcaaaccgccaaaggcagcggctatctttaacatcaagcttatgaaatgcggaggtgtcagtcaggcgcttaagattgccgacatcgcgctgccagagggcattgacctgttctgggggtgcaacgatgagagcattgttagcattacagctgccctgcatgctgctttttcgtgtgccaatacgaaatatattgacctggatggcagtcttgaccttgcaagagacgtagtaaagggcggatttatccttaaggatggttatatgtcctgctcggataaacccggccttggtgtagaaaggatttcttag

SEQ ID NO: 384 - protein, 356 aa, Unknown
  Obtained from environmental sample
  DOMAIN (3)...(124): Mandelate racemase / muconate lactonizing enzyme, N-terminal domain
  DOMAIN (141)...(235): Mandelate racemase / muconate lactonizing enzyme, C-terminal domain
MKIKDIKSWSVDLGNTKPYTIAFKTIDEVKNAFVEITLDNGVTGLGSGNPSEYVVGESFEQCLDALQDKNLDFLIGRDIREFNQLTYDVWKKFPENPSARAAIDIALHDAFTKFLDVPLVKFLGQKIKKLPTSNTIGIKNVEETVREAEDYKKRGFKVIKVKLGKDLDEDVERIMKLREKLGTGMVIRVDANQGYSREQTIQFYGRCYDLDIELIEQPLPAKEIAEMKSLPKEVRQVLAADESLITPADALELIKPPKAAAIFNIKLMKCGGVSQALKIADIALPEGIDLFWGCNDESIVSITAALHAAFSCANTKYIDLDGSLDLARDVVKGGFILKDGYMSCSDKPGLGVERIS

SEQ ID NO: 385 - DNA, 1101 bp, Unknown
  Obtained from environmental sample
  misc_feature (1)..(1101): n is a, c, g, or t
atggagcattatcggccggcacccggcacaccgctcaaggacctggacacaccctgcttactcgttgacctcgatgctgttgagcacaactttcgcctcattgctgacacgtatcgggacacagtctgcaaaatgcgcacccatgtcaagaatctcaaaagtcccatcctggcacacatgcagatacgcgctgggggcacagtgggcggagtgtgtgctgccaaggtcgctgaggctgaggtcatggtcgaaggggggatcacggatgtcctgattgccaatcaggtggtggcgcgtgccaagatcgtgcggctctgttcgctggcaaagcgagctgatatgaaggtcggcattgacaacgctcaaaacctgcgtgccttgtcggaagtggcgcaggctcaaggcgttaccctgggggtgctgatcgaagtcgacacctcaatgcatcgtgctggcatcaggcgcatcgaagacggggtcgagttggccaaactggcggcaacgctgcctggtattgcctttcggggcctcatgagccaccagacgctccctgggcgccctgacaagcaaactcgcctgattgagggacggcggttcatgcagacgtgcttggatctcaaggaagccattgagggtgctggcattcccgtcgacattgtctcaactggtgagacctggacctacgacatcgctgccgatctgccaggcgtgaccgaaatccagggcggcacgtatgcgcttatgtctgcctcctatggctacatggacgagtttgctattgctgccaaagtccttggcacgattataagcacaccgcgccctggtgtcgccattggcgatgtgggggtacaggctttggcgtcgcctggtggcgtgttgccatccgtggagggtatgcctggggtgacggttgaggcgttgcacgatgagcatattgtgttacgcaccgatggcaccacaccactcaccatcggggaccagtttctcctgcacagcggccagcaggatattttagtgaatcgctgggatcagtatattgccgtgcgtcagggggtagtagaagcggtgtgggatatcccggcgcgtgggtgtcatcattag

SEQ ID NO: 386 - protein, 366 aa, Unknown; identical to SEQ ID NO: 36
  Obtained from environmental sample
  DOMAIN (17)...(247): Alanine racemase, N-terminal domain
  misc_feature (1)..(366): Xaa is any amino acid

SEQ ID NO: 387 - DNA, 1065 bp, Unknown
  Obtained from environmental sample
  misc_feature (1)..(1065): n is a, c, g, or t
atgcgcccggcccgcgcccgtatcgccctcgatgcgctccgtcacaactacctcctcaccaggcagcaccatggacgccgcgcgcttgccgttatcaaggccaacgcctacggccacggcgcagtgcggtgcgcgcgtgcgctggaagatatcgccgacggtttcgcagtcgccatcgtcgaagaggcgatacagctccgggaggctggcattcgtggtccaatcctggtcctcgagggcatattcgatggcgatgacctcgccctcgcactacaacatcgcttatggctggtagtgcatcacgaggcgcagttgcgtttgctcgaggcggcgcgaatccctgacggcgccagcctcgacatctggctcaagctcaacaccggaatgaaccgtgctgggttcgaacctggcgaataccgggcggcatggcaacgcctgcgcacctgccggggagtgaacgacatcgtgctgatgactcatctgtcgcaggcggacgaaccccaggccggggcgacgatgcgccagatcgcactgttcgatgccaccaccagcggtgtcccaggtgagcgcagtatcgcgaactcggccggacttcttggatggagtgctgctcgtcgcgactgggggcggcccggcatttcgctctacggggccgatccaatgccgggcgaatccgccggtttgcgccctgtcatgaccctcgagagcgagatcatggcggtgcgtgacgtaccctccggagccgccattggctacggcgcgcgtttccgggcgcagcgcccgacacgcatcggactggtggcgatgggttacgccgatggctatccgcgcagcgccgccgacggcacgccggttctggtccacggtgcccgtagccggctgatcgggcgggtttccatggacatgctcacggtggatctcaccgatgtgcccgaggccgggctcggtagccgggtcgagctttgggggccgaacatatccatcaacgacgtcgcgcagggcgccggcaccattgcctacgagttgctgtgcaacgtcaaacgggtacgagtgctttacgattag

SEQ ID NO: 388 - protein, 354 aa, Unknown; identical to SEQ ID NO: 14
  Obtained from environmental sample
  DOMAIN (231)...(354): Alanine racemase, C-terminal domain
  misc_feature (1)..(354): Xaa is any amino acid

SEQ ID NO: 389 - DNA, 1080 bp, Unknown
  Obtained from environmental sample
  misc_feature (1)..(1080): n is a, c, g, or t
atgcaagcggcaactgttgttattaaccgccgcgctctgcgacacaacctgcaacgtctgcgtgaactggcacccgccagcaagctcgttgcagtcgtgaaagcgaacgcttacggacacggtcttcttgagaccgcgcgaacgctccccgatgccgatgcttttggcgtcgcccgtcttgaagaagctctgcgcctgcgtgcaggcggaattacccagcccattctgctgcttgaaggtttctttgaagccagcgacctcaccaccattgccgaccagcacctgcataccgcggtccataacgaagagcagcttgccgcgctggaaaccgctgagctcagcgagccagtgaccgtgtggatgaagctcgacaccgggatgcaccgtctgggcgtgcgcccggagaaggcggatgcgttttatcagcgcctgtgtcagtgcaaaaacgtgcgccagccggtcaatatcgtcagccactttgcccgtgccgatgagccggaatgtggcgccactgagcaacaactcgatatcttcaacaccttctgtgaaggcaaaccaggaatgcgctctattgccgcatccggcggtattttgctctggccgcagtcgcatttcgactgggcacgccctggcatcattctctatggcgtttcaccgctggacaacaagccctgggggccggattttggcttccagccggtgatgtcgctggtatctaacctgattgcggtgcgtgagcacaaagcgggtgagcctgtgggatacggtggaacctgggtcagcgagcgggatacgcggcttggcgtggtggctatggggtatggcgatggttatccacgcgctgcgccgtccggtacaccggtgctggtcaacggtcgtgaagtgacaattgtcggtcgcgtggcaatggacatgatctgcgtggatttggggcctgacgccgaagataaagcaggcgattcggtagtgatgtggggcgaaggactgcccgttgaacgcatcgcagcaataacgaaagtaagtgcttacgaactgatcacgcggctcacctcaagggtagcgatgaaatacgtcgagtag

SEQ ID NO: 390 - protein, 359 aa, Unknown; identical to SEQ ID NO: 26
  Obtained from environmental sample
  DOMAIN (234)...(358): Alanine racemase, C-terminal domain
  misc_feature (1)..(359): Xaa is any amino acid

SEQ ID NO: 391 - DNA, 1080 bp, Unknown
  Obtained from environmental sample
  misc_feature (1)..(1080): n is a, c, g, or t
atgcaagcggcaactgttgttattaaccgccgcgctctgcgacacaacctgcaacgtctgcgtgaactggcacccgccagcaagctcgttgcagtcgtgaaagcgaacgcttacggacacggtcttcttgagaccgcgcgaacgctccccgatgccgatgcttttggcgtcgcccgtcttgaagaagctctgcgcctgcgtgcaggcggaattacccagcctattttgctgctcgaaggcttctttgaagccagcgacctcaccaccattgccgaccagcacctgcataccgcggtccataacgaagagcagcttgccgcgctggaaaccgccgagctcagcgagccagtgaccgtttggatgaagctcgacaccgggatgcaccgtctgggcgtgcgcccggagaaggcggatgcgttttaccagcgcctgagtcagtgcaaaaacgtgcgccagccggtcaatatcgtcagccactttgcccgtgccgatgagccggaatgtggcgccacagagcaacagctcgatatcttcaacaccttctgtgaaggcaaaccaggaatgcgctctattgccgcatccggcggtattttgctctggccgcagtcgcatttcgactgggcacgtcctggcatcattctctatggcgtttcaccgctggacaacaaaccctgggggccggattttggcttccagccagtgatgtcgctggtgtctaacctgattgcggtgcgcgagcacaaagcgggcgagcctgtgggctacgggggaacctgggtcagcgagcgcgatacgcggcttggcgtggtggcgatggggtatggcgatggttatccacgcgctgcgccgtccggtacaccggtgctggtcaacggccgtgaagtgacaattgtcggtcgtgtggcaatggacatgatctgcgtggatttggggcctgacgccgaagataaagcgggcgattcggtagtgatgtggggcgaagggctgcccgttgaacgcatcgcagaaataacgaaagtaagtgcttacgaacttatcacgcggctcacctcaagggtagcgatgaaatacgtcgagtag

SEQ ID NO: 392 - protein, 359 aa, Unknown; identical to SEQ ID NO: 24
  Obtained from environmental sample
  DOMAIN (234)...(358): Alanine racemase, C-terminal domain
  misc_feature (1)..(359): Xaa is any amino acid

SEQ ID NO: 393 - DNA, 1017 bp, Unknown
  Obtained from environmental sample
  misc_feature (1)..(1017): n is a, c, g, or t
atgccgcgcgctattctggagataaacagtgaaaggataagacacaacgtcaagaagttatcggagttttccgggaaaaaggttatagcggttataaaggcggacgcctacggtataggttctatacaaatggcaaaaatactagagcctattgaagaagtggacgctttcgcggtagcctgcgttgaagagggggttgaactcaggaaaatgggaataaaaaaggaaatactcatactgggaggagtactgaaggatgaagtccctttagtagaggagtacttccttacccccgttgtttcggatattgagcacctgagagctataggaaacagggatataaagtttcacgtaaagtacgacacgggaatgggaagacttgggtttttgaacgaagttatacacgacccgagggtggaagggataatgagtcacctctcgagcccggcggacgaagaattttccaaactccagataaagaagtttgaggagatagttaagaagtacacaaaagttgagaaaatccacatggagagttcagcaggtgttgtgtacagagtgccttttaccactcacataagggtagggcttgcaatgtacggcgaaaaacccctgaagaattaccccgttgatataaaacccgcactcactcttaaagctaagttaatatccgtaaaggaacttcctgaaaattatccggtatcttacagcaggacgtacgtaactaagaaaaaaacgaaaacaggtgtagttgccttcgggtacgcggacggactcatgaaaacactgtccaacaggagttatttgctttataagggagaaaagctaccaattttcgggaacattaccatggacatgacaatagtggacctgaaaaatacggacgcaaaggtaggggattgggtttacgtggtaaacgaagaaagaacctttacggaacttgcaagagaagcgggaacgataccctatgagctcatgtgcaacttatcaaaaaggattaaaagagtcgtagtgtag

SEQ ID NO: 394 - protein, 338 aa, Unknown; identical to SEQ ID NO: 4
  Obtained from environmental sample
  DOMAIN (215)...(338): Alanine racemase, C-terminal domain
  misc_feature (1)..(338): Xaa is any amino acid

SEQ ID NO: 395 - DNA, 1149 bp, Unknown; identical to SEQ ID NO: 9
  Obtained from environmental sample
  misc_feature (1)..(1149): n is a, c, g, or t

SEQ ID NO: 396 - protein, 382 aa, Unknown; identical to SEQ ID NO: 10
  Obtained from environmental sample
  DOMAIN (253)...(380): Alanine racemase, C-terminal domain
  misc_feature (1)..(382): Xaa is any amino acid

SEQ ID NO: 397 - DNA, 1122 bp, Unknown
  Obtained from environmental sample
  misc_feature (1)..(1122): n is a, c, g, or t
atgcgcgacggcctccaccatgcaggcgcaacgcttaccgtcgacctcggcgccattcgcgccaactatcgcctgctccgccgccggctcggcgcgaccgcctgtgccgccgtcgtcaaggccgatgcctacggtctcggcgcggcggcggtcgcgccggcgctcgcacgcgaggggtgccggcagttcttcgtggcgcacctcgacgaggcgctcgcgctccgcccgctgctgccggaggccgaggtcttcgtgctgaacgggcttccggcaggcgccgaggctgagtgcgcggctcatcgggtgacgccggtcctgaacagcctcgcccagctcgacgcctgggcggcccatggccggcgcctcggccgggcgctgcccgcggcgctccaggtcgacagcggcatgtcgcggctcggcctcggcgaggccgaggtcgatgtgctcgcagaaagtccgcggcggctcgaaggcatcgggctccggctcgtcatgagccatctcgcctgcgccgagcggcaggaccacccgatgaaccgggagcagcttcgccgcttcgaggccgcgcgggcgcggctgccgaaggcgcccgcgagcctcgccaactcctccggcatcttcctcgggccggacttccacttcgacctggcccggcccggcgcggcgctctacggcctcgccccggtggcgggcgaggcgaacccgatgcggccggtcgtccgcctgcacggccggatcgtgcaggtccgcgaggtcgccgccggcgcggcggtcggctacggcgcgagctggcgagcggacgggccgcggcgcatcgccaccgtcgcggtcggctacgccgacggctacctgcgcagcctctccggccgcgccaccgccttttccggcgaggcacccgtgccgctggtcggcatcgtctcgatggacaccgcgaccttcgacgtcaccgacgcccccgcggcggtcgggggcggcttcctggagctgatcgggccgcgcaacccggtcgacgcgctcgccgcccaggccggcaccatcggctacgagatcctcacctcgctcggccaccgctacgcccgcgcctatgcggacgccgaccagcccgaaaggctcacggcatag

SEQ ID NO: 398 - protein, 373 aa, Unknown; identical to SEQ ID NO: 12
  Obtained from environmental sample
  DOMAIN (239)...(363): Alanine racemase, C-terminal domain
  misc_feature (1)..(373): Xaa is any amino acid

SEQ ID NO: 399 - DNA, 1161 bp, Unknown
  Obtained from environmental sample
  misc_feature (1)..(1161): n is a, c, g, or t
atggctccaccgctgtcgatggacaacggcaccaacgccctgaccgtgcagaacagcaacgcctgggttgaagtcagcgccagcgctctgcaacacaacatccgcaccctgcagacagagttgggtggcaagtccaaactgtgcgccgtgctcaaggccgacgcctatggccacggcattggcctggtgatgccatcgatcattgcccagggcgtgccctgcgtggcggtggccagcaacgaagaggcccgcgtggttcgcgccagcggctttaccgggcaactggtgcgggtacgcctggccagcctcagcgagctggaagacgccctgcaatacgacatggaggaactggtcggcagcgccgagttcgcccgccaggtcgatgccatcgccgcgcgccacggcaagacgctgcgcatccacatggcgctcaactccagcggcatgagccgcaacggcgtagagatggccacctggtccggccgtggcgaagcgctgcagatcactgaccagaagcacctcaagctggtcgcgctgatgacccacttcgccgtggaagacaaggacgatgtgcgcaagggcctggcggcgttcaatgagcaggccgactggctgatcaagcacgccaagcttgaccgcagcaaggtcaccctgcacgcggccaactcgttcgctacgctggaggtgccggaagcgcgcctggacatggtgcgtaccggtggcgcgctgttcggtgacaccgtgccggcgcgcaccgaatacaaacgtgccatgcagttcaagtcgcacgtggcggcggtgcacagctacccggccggcaacaccgtcggctacgaccgcaccttcaccctggcccgcgattcgcgcctggccaacatcaccgtcggctactccgacggctaccgccgggtcttcaccaacaagggccatgtgctgatcaacggccatcgcgtgccggtggtgggcaaggtttcgatgaacacgctgatggtcgatgtcaccgacttcccggacgtgaagggtggcaacgaagtggtgctgtttggcaagcaggccgggtctgaaatcacccaggccgaaatggaagaaatcaacgatgcgctgctcgccgacctgtacaccgtgtggggcagtgccaacccgaaaattctcgtcgactaa

SEQ ID NO: 400 - protein, 386 aa, Unknown
  Obtained from environmental sample
  DOMAIN (257)...(385): Alanine racemase, C-terminal domain
  misc_feature (1)..(386): Xaa is any amino acid
MAPPLSMDNGTNALTVQNSNAWVEVSASALQHNIRTLQTELGGKSKLCAVLKADAYGHGIGLVMPSIIAQGVPCVAVASNEEARVVRASGFTGQLVRVRLASLSELEDALQYDMEELVGSAEFARQVDAIAARHGKTLRIHMALNSSGMSRNGVEMATWSGRGEALQITDQKHLKLVALMTHFAVEDKDDVRKGLAAFNEQADWLIKHAKLDRSKVTLHAANSFATLEVPEARLDMVRTGGALFGDTVPARTEYKRAMQFKSHVAAVHSYPAGNTVGYDRTFTLARDSRLANITVGYSDGYRRVFTNKGHVLINGHRVPVVGKVSMNTLMVDVTDFPDVKGGNEVVLFGKQAGSEITQAEMEEINDALLADLYTVWGSANPKILVD

SEQ ID NO: 401 - DNA, 1164 bp, Unknown
  Obtained from environmental sample
  misc_feature (1)..(1164): n is a, c, g, or t
atggctccgccgatgtcgctggacaacggcacttcgcagctgaccgcgcaggtcagcaacgcctgggtggagatcaacaagactgccttcgagcacaacatccgcaccctgcaggcggagctcagtggcaagtcgaagctgtgcgcggtgctcaaggcggatgcctacggccacggcatcggcctgctgatgccgtcggtgatcgccatggacgtgccctgcgtcgccatcgccagcaacgaagaagcgcgggtggtgcgggccagcggcttcaagggcgaactggtgcgggtacgtaccggctccctggcggaagtcgaggatgccctcaagtacaacgtcgaggaactggtcggcaatgccgagttcgcccaccaggcgggcgagattgccgcgcgtcaaggccgcaagctgcgtgtgcacatcgcgttgaactccagcggcatgagtcgcaacgggctggaaatggaaagcgagcaaggccgccgcgacgccgtggccgttgcgaaggaaaagaaccccgaagtggtggcgatcatgacccactacgcggtggaggatcgcgaggatgtgctgaagggactggcggcgttcaaccggcaggccgactggctgatcaaggaagctggactggaccgcagcaagctgaccctgcacaccgccaactccttcgccaccctggaagtccccgaggcgcgcctggacatggtgcgtaccggcggtgcgctgttcggcgacaccgtggtcacccgcaccgagtacaagcgggtgatgcagttcaagtcgcacgtggcttcggtgaacgcctacccggcgggcaacagcgtcggctatgaccgcacctacaccatcaaccgcgactcgcggctggccaacatcaccgtcggctactccgatggctaccggcgggtattcaccaacaagggccatgtgctgatcgacggccaccgcgtgccggtggtgggcaaggtttcgatgaacaccctgatggttgacgtcaccgacttcccggacgtgaaggccggcgacgaagtggtgctgttcggcaagcagggcggcagcgagattgcccagagcgagatggaagacatcaatggtgcgctgctggccgacctgtacacggtctggggtagcgccaatccgaaagtgctggtcgagcaatag

SEQ ID NO: 402 - protein, 387 aa, Unknown
  Obtained from environmental sample
  DOMAIN (20)...(249): Alanine racemase, N-terminal domain
  misc_feature (1)..(387): Xaa is any amino acid
MAPPMSLDNGTSQLTAQVSNAWVEINKTAFEHNIRTLQAELSGKSKLCAVLKADAYGHGIGLLMPSVIAMDVPCVAIASNEEARVVRASGFKGELVRVRTGSLAEVEDALKYNVEELVGNAEFAHQAGEIAARQGRKLRVHIALNSSGMSRNGLEMESEQGRRDAVAVAKEKNPEVVAIMTHYAVEDREDVLKGLAAFNRQADWLIKEAGLDRSKLTLHTANSFATLEVPEARLDMVRTGGALFGDTVVTRTEYKRVMQFKSHVASVNAYPAGNSVGYDRTYTINRDSRLANITVGYSDGYRRVFTNKGHVLIDGHRVPVVGKVSMNTLMVDVTDFPDVKAGDEVVLFGKQGGSEIAQSEMEDINGALLADLYTVWGSANPKVLVEQ

SEQ ID NO: 403 - DNA, 1164 bp, Unknown
  Obtained from environmental sample
  misc_feature (1)..(1164): n is a, c, g, or t
atggctccgccgatgtcactggacaacggcacttcgcagctgaccgcgcaggtcagcaacgcctgggtggagatcaacaagactgccttcgagcacaacatccgcaccctgcaggcggagctcggtggcaagtcgaagctgtgcgcggtgctcaaggcggatgcctacggccacggcatcggcctgctgatgccgtcggtgatcgccatggacgtgccctgcgtcgccatcgccagcaacgaagaagcgcgggtggtgcgggccagcggcttcaagggcgaactggtgcgggtacgtaccggctccctggcggaagtcgaggatgccctcaagtacaacgtcgaggaactggtcggcaatgccgagttcgcctaccaggcgggcgagattgccgcgcgtcaaggccgcaagctgcgtgtgcacatcgcgttgaactccagcggcatgagtcgcaacgggctggaaatggaaagcgagcaaggccgccgcgacgccgtggccattgcgaaggaaaagaacctcgaagtggtggcgatcatgacccactacgcggtggaggatcgcgaggatgtgctgaagggactggcggcgttcaaccggcaggccgactggctgatcaaggaagctggactggaccgcagcaagctgaccctgcacaccgccaactccttcgccaccctggaagtccccgaggcgcgcctggacatggtgcgtaccggcggtgcgctgttcggcgacaccgtggtcacccgcaccgagtacaagcgagtgatgcagttcaagtcgcacgtggcttcggtgaacgcctacccggcgggcaacagcgtcggctatgaccgcacctacaccatcaaccgcgactcgcggctggccaacatcaccgtcggctactccgatggctaccggcgggtattcaccaacaagggccatgtgctgatcgacggccaccgcgtgccggtggtgggcaaggtttcgatgaacaccctgatggtcgacgtcaccgacttcccggacgtgaaggccggcgacgaagtggtgctgttcggcaagcagggcggcagcgagattgcccagagcgagatggaagacatcaatggtgcgctgctggccgacctgtacacggtctggggcagcgccaatccgaaagtgctggtcgagcaatag

SEQ ID NO: 404 - protein, 387 aa, Unknown
  Obtained from environmental sample
  DOMAIN (20)...(249): Alanine racemase, N-terminal domain
  misc_feature (1)..(387): Xaa is any amino acid
MAPPMSLDNGTSQLTAQVSNAWVEINKTAFEHNIRTLQAELGGKSKLCAVLKADAYGHGIGLLMPSVIAMDVPCVAIASNEEARVVRASGFKGELVRVRTGSLAEVEDALKYNVEELVGNAEFAYQAGEIAARQGRKLRVHIALNSSGMSRNGLEMESEQGRRDAVAIAKEKNLEVVAIMTHYAVEDREDVLKGLAAFNRQADWLIKEAGLDRSKLTLHTANSFATLEVPEARLDMVRTGGALFGDTVVTRTEYKRVMQFKSHVASVNAYPAGNSVGYDRTYTINRDSRLANITVGYSDGYRRVFTNKGHVLIDGHRVPVVGKVSMNTLMVDVTDFPDVKAGDEVVLFGKQGGSEIAQSEMEDINGALLADLYTVWGSANPKVLVEQ

SEQ ID NO: 405 - DNA, 1161 bp, Unknown
  Obtained from environmental sample
  misc_feature (1)..(1161): n is a, c, g, or t
atggctccaccgctgtcgatggacaacggcaccgccgccctgaccgcgcaaaacagcaacgcctgggtcgaaatcagtgccggcgcgctgcaacacaacatccgtaccttgcaggccgagctgggcgacaagtccaagttgtgcgccgtgctcaaggccgacgcctatggccacggtatcggcctggtgatgccgtcgatcatcgcccagggcgtgccttgcgtggcggtggccagcaacgaggaggcccgcgtggttcgcgccagcggcttcaccgggcaactggtgcgggtacgcctggccagcctcagcgaagtggaagatgccttgcagtacgacatggaagaactggtcggcagcgccgagttcgcccgccagctcgatgccatcgccgaacgccacggcaagaccctgcgcattcacatggcgctcaattccagtggcatgagccgcaacggcgtggaaatgaccacctggtccggccggggtgaagcgctgcagatcaccgaccagaagcacctcgagctggtcgcgctgatgacccacttcgccgtggaagacaaggacgatgtgcgcaaaggcctggcagcgttcaacgagcagaccgactggctgatcaagcacgcgaaacttgatcgcagcaagctcaccctgcacgccgccaactccttcgctacgctggaagtgccggaagcgcgcctggacatggtgcgcaccggcggcgcgctgttcggcgacaccgtgccgacgcacaccgaataccaacgtgccatgcagttcaagtcgcacgtggcagcggtgcacagctacccggcaggcaacaccgtcggctatgaccgcaccttcaccctggcgcgtgattcgcgcctggcgaacatcaccgtcggctactccgatggctaccgccgggtgttcaccaacaagggccatgtgctgatcaacggccaccgtgtgccggtggtgggcaaggtgtcgatgaacacgttgatggtcgatgtcaccgacttccccgatgtgaagggtggcaacgaagtggtgctgttcggcaaacaggccgggggtgaaatcacccaggccgaaatggaagaaatcaacggcgcgctgctcgccgacctgtacaccgtatggggcagttccaacccgaagattctcgtcgactag

SEQ ID NO: 406 - protein, 386 aa, Unknown
  Obtained from environmental sample
  DOMAIN (257)...(385): Alanine racemase, C-terminal domain
  misc_feature (1)..(386): Xaa is any amino acid
MAPPLSMDNGTAALTAQNSNAWVEISAGALQHNIRTLQAELGDKSKLCAVLKADAYGHGIGLVMPSIIAQGVPCVAVASNEEARVVRASGFTGQLVRVRLASLSEVEDALQYDMEELVGSAEFARQLDAIAERHGKTLRIHMALNSSGMSRNGVEMTTWSGRGEALQITDQKHLELVALMTHFAVEDKDDVRKGLAAFNEQTDWLIKHAKLDRSKLTLHAANSFATLEVPEARLDMVRTGGALFGDTVPTHTEYQRAMQFKSHVAAVHSYPAGNTVGYDRTFTLARDSRLANITVGYSDGYRRVFTNKGHVLINGHRVPVVGKVSMNTLMVDVTDFPDVKGGNEVVLFGKQAGGEITQAEMEEINGALLADLYTVWGSSNPKILVD

SEQ ID NO: 407 - DNA, 1161 bp, Unknown
  Obtained from environmental sample
  misc_feature (1)..(1161): n is a, c, g, or t
atggctccaccgctgtcgatggacaacggcaccaacgccctgaccgtgcagaacagcaacgcctgggttgaagtcagcgccagcgctctgcaacacaacatccgcaccctgcagacagagttgggtggcaagtccaaactgtgcgccgtgctcaaggccgacgcctatggccacggcatcggcctggtgatgccatcgatcattgcccagggcgtgccctgcgtggcggtggccagcaacgaagaggcccgcgtggttcgcgccagcggctttaccgggcaactggtgcgggtacgcctggccagcctcagcgagctggaagacgccctgcaatacgacatggaagaactggtcggcagcgccgagttcgcccgccaggtcgatgccatcgccgcgcgccacggcaagacgctgcgcatccacatggcgctcaactccagcggcatgagccgcaacggcgtagagatggccacctggtccggccgtggcgaagcgctgcagatcactgaccagaagcacctcaagctggtcgcgctgatgacccacttcgccgtggaagacaaggacgatgtgcgcaagggcctggcggcgttcaatgagcaggccgactggctgatcaagcacgccaagcttgaccgcagcaaggtcaccctgcacgcggccaactcgttcgctacgctggaggtgccggaagcgcgcctggacatggtgcgtaccggtggcgcgctgttcggtgacaccgtgccggcgcgcaccgaatacaaacgtgccatgcagttcaagtcgcacgtggcggcggtgcacagctacccggccggcaacaccgtcggctacgaccgcaccttcaccctggcccgcgattcgcgcctggccaacatcaccgtcggctactccgacggctaccgccgggtcttcaccaacaagggccatgtgctgatcaacggccatcgcgtgccggtggtgggcaaggtttcgatgaacacgctgatggtcgatgtcaccgacttcccggacgtgaagggtggcaacgaagtggtgctgtttggcaagcaggccgggtctgaaatcacccaggccgaaatggaagaaatcaacgatgcgctgctcgccgacctgtacaccgtgtggggcagtgccaacccgaaaattctcgtcgactag

SEQ ID NO: 408 - protein, 386 aa, Unknown; identical to SEQ ID NO: 400
  Obtained from environmental sample
  DOMAIN (257)...(385): Alanine racemase, C-terminal domain
  misc_feature (1)..(386): Xaa is any amino acid

SEQ ID NO: 409 - DNA, 1161 bp, Unknown
  Obtained from environmental sample
  misc_feature (1)..(1161): n is a, c, g, or t
atggctccaccgctgtcgatggacaacggcaccaacgccctgaccgtgcagaacagcaacgcctgggttgaagtcagcgccagcgctctgcaacacaacatccgcaccctgcagacagagttgggtggcaagtccaaactgtgcgccgtgctcaaggccgacgcctatggccacggcattggcctggtgatgccatcgatcattgcccagggcgtgccctgcgtggcggtggccagcaacgaagaggcccgcgtggttcgcgccagcggctttaccgggcaactggtgcgggtacgcctggccagcctcagcgagctggaagacgccctgcaatacgacatggaagaactggtcggcagcgccgagttcgcccgccaggtcgatgccatcgccgcgcgccacggcaagacgctgcgcatccacatggcgctcaactccagcggcatgagccgcaacggcgtagagatggccacctggtccggccgtggcgaagcgctgcagatcactgaccagaagcacctcaagctggtcgcgctgatgacccacttcgccgtggaagacaaggacgatgtgcgcaagggcctggcggcgttcaatgagcaggccgactggctgatcaagcacgccaagcttgaccgcagcaaggtcaccctgcacgcggccaactcgttcgctacgctggaggtgccggaagcgcgcctggacatggtgcgtaccggtggcgcgctgttcggtgacaccgtgccggcgcgcaccgaatacaaacgtgccatgcagttcaagtcgcacgtggcggcggtgcacagctacccggccggcaacaccgtcggctacgaccgcaccttcaccctggcccgcgattcgcgcctggccaacatcaccgtcggctactccgacggctaccgccgggtcttcaccaacaagggccatgtgctgatcaacggccatcgcgtgccggtggtgggcaaggtttcgatgaacacgctgatggtcgatgtcaccgacttcccggacgtgaagggtggcaacgaagtggtgctgtttggcaagcaggccgggtctgaaatcacccaggccgaaatggaagaaatcaacgatgcgctgctcgccgacctgtacaccgtgtggggcagtgccaacccgaaaattctcgtcgactag

SEQ ID NO: 410 - protein, 386 aa, Unknown; identical to SEQ ID NO: 400
  Obtained from environmental sample
  DOMAIN (257)...(385): Alanine racemase, C-terminal domain
  misc_feature (1)..(386): Xaa is any amino acid

SEQ ID NO: 411 - DNA, 1521 bp, Unknown
  Obtained from environmental sample
  misc_feature (1)..(1521): n is a, c, g, or t
atggccgaaacaaatctgcataaaaaaataaatattgaaatgcattttgataacttagtgtctaattttgaaaaaattagaaaattaaacaacgaaaatgttgatgtagctgataaagtaataccggtcgtaaaggcaaatgcatataattttggagtttatgacatcactaagacttttttatcaatgaaagaaccacaaacaaagttttttgtttttagtctggaagaaggcattgagctcaggaaattttttccatccatagagagaatatttgtaataatgggggctctggaaaacgacgcggagttatttaaaaaatataacttaactcctgttgtaaattctttttatcagctggaagtgtgcaaaaagcataacattaaaaacattgtattacagtttaatacagggatgaatagaaatggatttgaagtaaaagaattaagaaaagttaaacaaatttgtgatagtgaaaaatttaatgtattaatggtaatgagccattttgcttgtagcgacaatatggccagtgaagtcaatgcatatcaaataaatgaatataaaaaagtggcacgagtttttaatgataaaaagattattaaatcttttcctgcaacttttggtatattaaattttaatactataaatggattagttaactcttttagacccggaagattatattatggatttcttccaaaagaaggatatgataaaaatttgttttctgtttatgtttatctaagtaaagataaagaaggaaatattattttgccgttcggtaaagaagatggtattgactatggtgagcaagcatatattttagtggataaaaataaggcatatgtaaagcaagtagatagtcataaagtaatattagatacaaacgataaaacattagttggcaaaaaagtatatctaataaaaaatggtatgggatatgatgagtttaaagaacaatctaaacaagacctgctaactttttttggaaaaatctttaaaaattgcgataaaaataaaaatttatgcaatatcaatgcaacaaggaagagagccaaaaaagacaataaatttgttccaaaagcaatatttaaaaaggatgcgaaaggacaatatactcaatatacaactactttatttgagaaacgagaagttagtgctgacggtattgttggatatgatgcaacaagagctgtaaaaaaaggtgacaagttaggtgtaatttttaatggtcatatggatggtttttatcagcctatgagtaataaacatgtgtttgtttatgtgaaaaacaaatacaaacaacttataccttgtgaattttatggtttgatttcttccgatcaggctgtaattaaaattcctaatgatgagtttgataatatagagtatggtgcaaaggttgtggtttttgacaaaaatcacccaataacattatttgagcaagcaacaggtgtttcaagagatgaattattttatggattagataagacatatagaatagcagaacaaaaatag

SEQ ID NO: 412 - protein, 506 aa, Unknown
  Obtained from environmental sample
  DOMAIN (377)...(501): Alanine racemase, C-terminal domain
  misc_feature (1)..(506): Xaa is any amino acid
MAETNLHKKINIEMHFDNLVSNFEKIRKLNNENVDVADKVIPVVKANAYNFGVYDITKTFLSMKEPQTKFFVFSLEEGIELRKFFPSIERIFVIMGALENDAELFKKYNLTPVVNSFYQLEVCKKHNIKNIVLQFNTGMNRNGFEVKELRKVKQICDSEKFNVLMVMSHFACSDNMASEVNAYQINEYKKVARVFNDKKIIKSFPATFGILNFNTINGLVNSFRPGRLYYGFLPKEGYDKNLFSVYVYLSKDKEGNIILPFGKEDGIDYGEQAYILVDKNKAYVKQVDSHKVILDTNDKTLVGKKVYLIKNGMGYDEFKEQSKQDLLTFFGKIFKNCDKNKNLCNINATRKRAKKDNKFVPKAIFKKDAKGQYTQYTTTLFEKREVSADGIVGYDATRAVKKGDKLGVIFNGHMDGFYQPMSNKHVFVYVKNKYKQLIPCEFYGLISSDQAVIKIPNDEFDNIEYGAKVVVFDKNHPITLFEQATGVSRDELFYGLDKTYRIAEQK

SEQ ID NO: 413 - DNA, 1032 bp, Unknown
  Obtained from environmental sample
  misc_feature (1)..(1032): n is a, c, g, or t
atggcgctctccctctacgtcgacaccgctcgctggcgcgcgcaccagaagaccgtcatcgaccagttccccggcgtgatcccggtctgcaagggcaacggctacggcttcggccacgagcgcctcgcggacgaggcggcgcggttcggtgccgacatgctggccgtgggcaccacgtacgaggccgcgaagatcaaggactggttcagcggcgacctgctggtcctcaccccgttccgccggggtgaggaaccggttccgctgcccgaccgggtcatccgctccgtgtcgtccgtggacggcgtccacgccctcgtgggcgcccgggtcgtcatcgagtgcatgagctcgatgaagcggcacggcgtccgcgaggaggagctcccgcagctccactcggccatcgaggacgtccgcctcgaaggcttcgcgctgcacctgcccctggaccgcccggacggcacggacgccgtcgaggaggtcatcggctggatggaccggctgcgggccgcccggctgccgctgcacaccatgttcgtcagccacctgcgggcggaggagcaggccaggctccagcagcagttcccgcagacccgcttccgcgcccggatcggtacccggctgtggctgggcgaccacgaggccacggagtaccggggtgcggtcctcgacgtgacccgggtcgccaagggcgaccgcttcggctaccgccagcagaaggccgcttcggacggctggctggtcgtcgtcgccggcggtacctcgcacggcgtcggcctggaggctcccaaggcgatgcacggcgtcatgccgcgtgccaagggcgtcgcgcgggccggtctcgccaccgtcaaccgcaacctctcgccgttcgtgtgggccggcaagcagcgctggttcgccgagccgccgcatatgcaggtgtcgatcctgttcgtgccgtccgacgcgcaggagccccgggtcggcgacgaactggtggcccatctgcggcacacgacgacgcagttcgaccggctcgtggagcgctag

SEQ ID NO: 414 - protein, 343 aa, Unknown; identical to SEQ ID NO: 8
  Obtained from environmental sample
  DOMAIN (2)...(216): Alanine racemase, N-terminal domain
  misc_feature (1)..(343): Xaa is any amino acid

SEQ ID NO: 415 - DNA, 1167 bp, Unknown
  Obtained from environmental sample
  misc_feature (1)..(1167): n is a, c, g, or t
atggctccctatctgccccttgtgacggatcatcgcagcggccaggagcaaaccgccagcaacgcctggttggaagtggatctgggcgcctttgagcacaatatccagaccctcaaggatcgcctcggcgacaagggcccgcagatctgcgccatcatgaaggccgacgcttacggtcatggcatcgacctgctggtcccctccgtggtcaaggccaatatcccctgcatcggcatcgccagcaacgaagaggcgcgcgtcgcccgcgagaagggctttaccggccgtctgatgcgggtgcgtgctgccaccccggatgaagtagagcaggccctgccctacaagatggaggagctgatcggcagtctggtgagtgcccagggtatcgccgatatcgcccagcgccaccacaccaccattccggtgcatatcgcgctcaactccgccggcatgagccgcaacggcatcgacctgcgtctggccgatgccaagcaggatgcgctggccatgctcaagctaaaggggatcaccccggtcggcatcatgacccacttcccggttgaggagaaagaggacgtcaagatggggctggcccagttcaaactggactcccagtggctgctggaagcgggcaaactggatcgcagcaagatcaccatccacgccgccaactccttcgccactctggccgtgccggacgcctacttcgacatggtgcgcccgggcggcctgctctacggtgactccatcccctcccacaccgagtacaagcgggtgatggcattcaagacccaggtcgcctcggtcaaccactatgccgcgggcaacaccgtcggttatgaccgcacctttaccctcaagcgtgactcctggctcgccaacctgccgctgggctactccgatggctatcgccgcgccctcagcaacaaagcctatgtgctgatcaagggtcagaaggtgccggtggtcggcaagacttccatgaacaccatcatggtggatgtgactgatctgaaaggggtgaaacccggtgacgaggtggtgctgtttggccgtcagggtgaaaccgaagtgaaacaggcggatctggaggagtacaacggcgccctgctggcggacatgtacaccatctggggctacaccaaccccaagaagatcaaccgctaa

SEQ ID NO: 416 - protein, 388 aa, Unknown
  Obtained from environmental sample
  DOMAIN (259)...(376): Alanine racemase, C-terminal domain
  misc_feature (1)..(388): Xaa is any amino acid
MAPYLPLVTDHRSGQEQTASNAWLEVDLGAFEHNIQTLKDRLGDKGPQICAIMKADAYGHGIDLLVPSVVKANIPCIGIASNEEARVAREKGFTGRLMRVRAATPDEVEQALPYKMEELIGSLVSAQGIADIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHYAAGNTVGYDRTFTLKRDSWLANLPLGYSDGYRRALSNKAYVLIKGQKVPVVGKTSMNTIMVDVTDLKGVKPGDEVVLFGRQGETEVKQADLEEYNGALLADMYTIWGYTNPKKINR

SEQ ID NO: 417 - DNA, 1167 bp, Unknown
  Obtained from environmental sample
  misc_feature (1)..(1167): n is a, c, g, or t
atggccccttacctgccgctggccagcgatcatcgcaacggcgaagtgcagaccgccagcaatgcctggctggaagtcgatctcggcgccttcgagcacaacatccagaccctcaaggatcgcctcggtgacaaagggccgaagatctgcgccatcatgaaggccgacgcctacggccacggcatcgacctgctggtcccctcggtggtcaaggccggtatcccctgcatcggcatcgccagcaacgaagaggcccgcgtggcccgcgagaagggcttcaccggccgcctaatgcgggtgcgtgccgccaccccggccgaagtggagcaggccctgccctacaagatggaagaactcatcggcagcctggtgagtgcccagggcatcgccgacatcgcccagcgccaccacaccaatatcccggtgcacatcgcgctcaactccgccggcatgagccgcaacggcatcgatctgcgtctggctgactccaagaaagacgcgctggccatgctcaagctcaaggggatcaccccggtcggcatcatgacccacttcccggtggaggagaaagaggacgtcaagatggggctggcccagttcaagctggactcccagtggctgccggaagcgggcaagctggatcgcagcaagatcaccatccacgccgccaactccttcgccaccctggaagtgccggacgcctacttcgacatggtgcgcccgggtggcctgctgtacggcgactccatcccctcctacaccgagtacaagcgggtgatggcgttcaagacccaggttgcctccgtcaaccactacccggccggcaacaccgtcggttatgaccgcaccttcaccctcaagcgcgactcctggctcgccaacctgccgctgggctactccgacggctatcgccgggcgctgagcaacaaggcctatgtgctgatccagggccagaaggtgccggtggtgggcaagacctccatgaacaccatcatggtggacgtgaccgatctcaagggagtcaaacccggtgacgaggtggtgctgttcggccgccagggtgaagccgaggtgaaacaggcggatctcgaggagtacaacggcgccctgctggcggacatgtacaccatctggggctacaccaaccccaagaagatcaaacgctaa

SEQ ID NO: 418 - protein, 388 aa, Unknown
  Obtained from environmental sample
  DOMAIN (259)...(387): Alanine racemase, C-terminal domain
  misc_feature (1)..(388): Xaa is any amino acid
MAPYLPLASDHRNGEVQTASNAWLEVDLGAFEHNIQTLKDRLGDKGPKICAIMKADAYGHGIDLLVPSVVKAGIPCIGIASNEEARVAREKGFTGRLMRVRAATPAEVEQALPYKMEELIGSLVSAQGIADIAQRHHTNIPVHIALNSAGMSRNGIDLRLADSKKDALAMLKLKGITPVGIMTHFPVEEKEDVKMGLAQFKLDSQWLPEAGKLDRSKITIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 419 - DNA, 1167 bp, Unknown
  Obtained from environmental sample
  misc_feature (1)..(1167): n is a, c, g, or t
atggctccctacctgccgctcgccagcgacacccgcaacggtcaggagcagaccgccaccaacgcctggctggaagttgatctgggcgccttcgagcacaacatccagaccctcaaggatcgcctcggtgacaagggcccgcagatctgcgccatcatgaaggcggacgcctacggtcacggcatcgatctgctggtgccctcggtggtcaaggccaacattccctgcatcggcatcgccagcaacgaagaggcccgcgtggcccgtgagaagggcttcgaaggccggctgatgcgggtccgtgccgccaccccgaccgaggtggagcaggccctgccctacaaactagaagagctcatcggcagcctggagagtgccaagggcatctccgacatcgccctgcgccacaacaccaaagtgccggtgcaccttggcttgaactccgccggcatgagccgcaacggcatcgacttgcgccaggccggcgccaaggaagagaccctggccatgctcaagctgccgggcatcaccccggtcggcatcatgacccacttcccggtggaggagaaagaggacgtcaagctgggcctggcccagttcaagctggacagccagtggctgctggaagcgggcaagctggatcgcagcaaaatcaccatccatgccgccaactccttcgccaccctggaagtgcctgacgcctacttcgacatggtgcgcccgggcggcctgctgtacggcgactccatcccctcctacaccgagtacaagcgcgtcatggcgttcaagacccaggtcgcctcggtcaaccactacccggccggcaacaccgtcggctatgaccgcacctttaccctcaagcgcgactccctgctggcgaacctgccgctgggttactccgacggctatcgccgcgcgctcagcaacaaggcctatgtgttgatccagggtcagaaggtgcctgtggtcggcaagacctccatgaacaccatcatggtggacgtgactgatctgaagggagtgaaacccggtgacgaggtggtgctgttcggccgccagggcaaggccgaggtgaaacaggcggatctggaggagtacaacggcgccctgctggcggacatgtacaccatctggggctacaccaaccccaagaagatcaatcgctaa

SEQ ID NO: 420 - protein, 388 aa, Unknown
  Obtained from environmental sample
  DOMAIN (259)...(376): Alanine racemase, C-terminal domain
  misc_feature (1)..(388): Xaa is any amino acid
MAPYLPLASDTRNGQEQTATNAWLEVDLGAFEHNIQTLKDRLGDKGPQICAIMKADAYGHGIDLLVPSVVKANIPCIGIASNEEARVAREKGFEGRLMRVRAATPTEVEQALPYKLEELIGSLESAKGISDIALRHNTKVPVHLGLNSAGMSRNGIDLRQAGAKEETLAMLKLPGITPVGIMTHFPVEEKEDVKLGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGKAEVKQADLEEYNGALLADMYTIWGYTNPKKINR

SEQ ID NO: 421 - DNA, 1167 bp, Unknown
  Obtained from environmental sample
  misc_feature (1)..(1167): n is a, c, g, or t
atggctccctacctgccgctcgccagcgacacccgcaacggtcaggagcaaaccgccgccaacgcctggctggaagtggatctgggcgccttcgagcacaacatccagaccctcaaggatcgcctcggtgacaagggcccgcagatctgcgccatcatgaaggcggacgcctacggtcacggcatcgatctgctggtgccctcggtggtcaaggccaacatcccctgcatcggcatcgccagcaacgaagaggcccgggtggctcgggagaaaggcttcgaaggccgactgatgcgggtccgtgccgccaccccgaccgaggtggagcaggccctgccctacaagctcgaagagctcatcggcagcctggagagtgccaagggcatctccgacatcgccctgcgccacagcaccaaggtgccggtgcacatcggtctgaactccgccggcatgagccgcaacggcatcgacctgcgccagtccggcgccaaggacgaggccctgaccatgctcaagctgccgggcatcaccccggtcggcatcatgacccacttcccggtggaggagaaagaggacgtcaagctgggtctggcccagttcaagctggacagccagtggctgctggaagcgggcaagctggatcgcagcaagatcaccatccatgccgccaactccttcgccactctggaagtgcctgacgcctacttcgacatggtgcgcccgggcggcctgctgtacggcgactccatcccctcctacaccgagtacaagcgcgtgatggcgttcaagacccaggtcgcctcggtcaaccactacccggccggcaacaccgtcggctatgaccgcaccttcaccctcaagcgtgactccctgctggcgaacctgccgctcggttactccgacggttatcgccgcgcgctcagcaacaaggcctatgtgctgatccagggtcagaaggtgcctgtggtcggcaagacctccatgaacaccatcatggtggacgtgaccgacctgaagggagtgaaacccggtgacgaggtggtgctgtttggccgccagggagaggccgaggtgaaacaggcggatctggaggagtacaacggcgccctgctggcggacatgtacaccatctggggctacaccaaccccaagaagatcaaccgctaa

SEQ ID NO: 422 - protein, 388 aa, Unknown
  Obtained from environmental sample
  DOMAIN (259)...(376): Alanine racemase, C-terminal domain
  misc_feature (1)..(388): Xaa is any amino acid
MAPYLPLASDTRNGQEQTAANAWLEVDLGAFEHNIQTLKDRLGDKGPQICAIMKADAYGHGIDLLVPSVVKANIPCIGIASNEEARVAREKGFEGRLMRVRAATPTEVEQALPYKLEELIGSLESAKGISDIALRHSTKVPVHIGLNSAGMSRNGIDLRQSGAKDEALTMLKLPGITPVGIMTHFPVEEKEDVKLGLAQFKLDSQWLLEAGKLDRSKITIHAANSFATLEVPDAYFDMVRPGGLLYGDSIPSYTEYKRVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 423 - DNA, 1161 bp, Unknown
  Obtained from environmental sample
  misc_feature (1)..(1161): n is a, c, g, or t
atggctccaccgctgtcgatggacaacggcaccgacgccctgaccgtacagaacagcaacgcctgggtcgaagtcagcgccagcgccctgcaacacaacatccgcaccttgcaggccgagctgggcggcaagtccaggctgtgcgccgtgctcaaggccgacgcctatggccatggcatcggcctggtgatgccgtcgatcattgcccagggcgtgccctgcgtggcggtggccagcaacgaagaggcccgtgtggtccgcgccagcggctttaccgggcaactggtgcgggttcgcctggccagcctcagcgagctggaagacgccttgcagtacgacatggaagagctggtcggcagcgccgagttcgcccgccaggtcgatgccattgccgcacgccatggcaagaccctgcgcattcacatggcgctcaactcaagcggcatgagccgcaacggggtggagatgaccacttggtccggccgtggcgaagcgctgcagatcaccgatcagaaacacctcaagctggtcgcgctgatgacccactttgccgtggaggacaaggacgatgtgcgcaacggcctggcggcgttcaacgaacagaccgactggctgatcaagcacgcaaaacttgatcgcagcaagctcaccctgcacgcggccaactcgttcgctaccctggaggtgccggaagcgcgcctggacatggtgcgcaccggtggcgcgctgttcggcgacaccgtgccggcgcgcaccgagtaccagcgcgccatgcagttcaagtcgcacgtggcggcggtgcacagctacccggccggcaacaccgtcggctacgaccgcaccttcaccctggcccgtgacccacgcctggccaacatcaccgtcggctactccgacggctaccgccgggtcttcaccaacaagggccatgtgctgatcaacggccaccgcgtgccggtggtgggcaaggtctcgatgaatacgctgatggtggatgtcaccgatttccccgacgtgaagggtggcaacgaagtggtgctgttcggcaagcaggccggggctgaaataacccaggccgagatggaagaaatcaacgacgcgctgctcgccgacctgtacaccgtatggggcagcgccaacccgaagatgctcgtcgactaa

SEQ ID NO: 424 - protein, 386 aa, Unknown
  Obtained from environmental sample
  DOMAIN (257)...(385): Alanine racemase, C-terminal domain
  misc_feature (1)..(386): Xaa is any amino acid
MAPPLSMDNGTDALTVQNSNAWVEVSASALQHNIRTLQAELGGKSRLCAVLKADAYGHGIGLVMPSIIAQGVPCVAVASNEEARVVRASGFTGQLVRVRLASLSELEDALQYDMEELVGSAEFARQVDAIAARHGKTLRIHMALNSSGMSRNGVEMTTWSGRGEALQITDQKHLKLVALMTHFAVEDKDDVRNGLAAFNEQTDWLIKHAKLDRSKLTLHAANSFATLEVPEARLDMVRTGGALFGDTVPARTEYQRAMQFKSHVAAVHSYPAGNTVGYDRTFTLARDPRLANITVGYSDGYRRVFTNKGHVLINGHRVPVVGKVSMNTLMVDVTDFPDVKGGNEVVLFGKQAGAEITQAEMEEINDALLADLYTVWGSANPKMLVD

SEQ ID NO: 425 - DNA, 1092 bp, Unknown
  Obtained from environmental sample
  misc_feature (1)..(1092): n is a, c, g, or t
atggctagcaatgcctgggtggaaatcgatcaggcggcgttcgagcacaatattcgcaccttgcagaccctgctcgacggcaagtcgcagatctgtgccatcatgaaggccgacgcctacggccatggcatcgccaacctgatgccctcggtgatggccgccaatatcccctgcatcggcattaccagcaacgaagaagcccgagtggtgcgggaaagcggctatcaagggcgcatcatgcgggtacgcagcgccacgccggcggaagtaagcgatggtctgcaatacgagatggaggagctgttcggcgatatcgaggcggcccgccaggcggccgaggtggccaaggccgccggcaagaccctgcgttatcacctgggcctgaatgccggcggcatgagccgcaacggcctggaagtggcgaccgaagccggcaagcaggaagcccgcgagctgctggcgcaggagaatctggaactggtcggcattatgacccatttccagtatgaagacgcggacttcgtgcgcgccgggctggccaaattcaatgaacagtctaagtggctgatcgaagacggcaagctggatcgcagcaagctgaccctgcatgcggccaactccttcaccaccctggaagtgccggaagcccggctggatatggttcgccccggcggcatcatctatggcgacaccattccttcctataccgaatacaagaaggtgatgtcgttcaagacccgggtggcgtcggtcaacaactacccggccggcagcctggtgggctatgacggcacctataccctggagcgggattcactgctggccaacctgccgatgggctattccgacggttaccgccgggtgttcaccaacagggcctatgtggtggtcaacggccagcgggcgccggtggtgggcaaggtgtcgatgaacaccaccatgatcgatgtgaccgatattccgggcgtcaagccgggggatgaagtggtgctgttcggcaagcagggcggggcggaagtcacccagggcgagctggaagacgccaacggcgccctgctggcggacctgtacaccgtctggggctacgcctaa

SEQ ID NO: 426 - protein, 363 aa, Unknown
  Obtained from environmental sample
  DOMAIN (241)...(358): Alanine racemase, C-terminal domain
  misc_feature (1)..(363): Xaa is any amino acid
MASNAWVEIDQAAFEHNIRTLQTLLDGKSQICAIMKADAYGHGIANLMPSVMAANIPCIGITSNEEARVVRESGYQGRIMRVRSATPAEVSDGLQYEMEELFGDIEAARQAAEVAKAAGKTLRYHLGLNAGGMSRNGLEVATEAGKQEARELLAQENLELVGIMTHFQYEDADFVRAGLAKFNEQSKWLIEDGKLDRSKLTLHAANSFTTLEVPEARLDMVRPGGIIYGDTIPSYTEYKKVMSFKTRVASVNNYPAGSLVGYDGTYTLERDSLLANLPMGYSDGYRRVFTNRAYVVVNGQRAPVVGKVSMNTTMIDVTDIPGVKPGDEVVLFGKQGGAEVTQGELEDANGALLADLYTVWGYA

SEQ ID NO: 427 - DNA, 1230 bp, Unknown; identical to SEQ ID NO: 53
  Obtained from environmental sample
  misc_feature (1)..(1230): n is a, c, g, or t

SEQ ID NO: 428 - protein, 409 aa, Unknown; identical to SEQ ID NO: 54
  Obtained from environmental sample
  SIGNAL (1)...(23)
  DOMAIN (42)...(271): Alanine racemase, N-terminal domain
  misc_feature (1)..(409): Xaa is any amino acid

SEQ ID NO: 429 - DNA, 1230 bp, Unknown
  Obtained from environmental sample
  misc_feature (1)..(1230): n is a, c, g, or t
atgccattttcccgtacactactggctgcatccctcgctctgctgatcaccggccaggccccgttgtacgccgcaccacccctgtcgatggacaacggcaccgccgccctgaccgcgcaaaacagcaacgcctgggtcgaaatcagtgccggcgcgctgcaacacaacatccgtaccttgcaggccgagctgggcgacaagtccaagttgtgcgccgtgctcaaggccgacgcctatggccacggtatcggcctggtgatgccgtcgatcatcgcccagggcgtgccttgcgtggcggtggccagcaacgaggaggcccgcgtggttcgcgccagcggcttcaccgggcaactggtgcgggtacgcctggccagcctcagcgaagtggaagatgccttgcagtacgacatggaagaactggtcggcagcgccgagttcgcccgccagctcgatgccatcgccgaacgccacggcaagaccctgcgcattcacatggcgctcaattccagtggcatgagccgcaacggcgtggaaatgaccacctggtccggccggggtgaagcgctgcagatcaccgaccagaagcacctcgagctggtcgcgctgatgacccacttcgccgtggaagacaaggacgatgtgcgcaaaggcctggcagcgttcaacgagcagaccgactggctgatcaagcacgcgaaacttgatcgcagcaagctcaccctgcacgccgccaactccttcgctacgctggaagtgccggaagcgcgcctggacatggtgcgcaccggcggcgcgctgttcggcgacaccgtgccgacgcacaccgaataccaacgtgccatgcagttcaagtcgcacgtggcagcggtgcacagctacccggcaggcaacaccgtcggctatgaccgcaccttcaccctggcgcgtgattcgcgcctggcgaacatcaccgtcggctactccgatggctaccgccgggtgttcaccaacaagggccatgtgctgatcaacggccaccgtgtgccggtggtgggcaaggtgtcgatgaacacgttgatggtcgatgtcaccgacttccccgatgtgaagggtggcaacgaagtggtgctgttcggcaaacaggccgggggtgaaatcacccaggccgaaatggaagaaatcaacggcgcgctgctcgccgacctgtacaccgtatggggcagttccaacccgaagattctcgtcgactag

SEQ ID NO: 430 - protein, 409 aa, Unknown; identical to SEQ ID NO: 58
  Obtained from environmental sample
  SIGNAL (1)...(24)
  DOMAIN (280)...(408): Alanine racemase, C-terminal domain
  misc_feature (1)..(409): Xaa is any amino acid

SEQ ID NO: 431 - DNA, 1161 bp, Unknown
  Obtained from environmental sample
  misc_feature (1)..(1161): n is a, c, g, or t
atggctccaccgctgtcgatggacaacggcaccaacgccctgaccgtgcagaacagcaacgcctgggttgaagtcagcgccagcgctctgcaacacaacatccgcaccctgcagacagagttgggtggcaagtccaaactgtgcgccgtgctcaaggccgacgcctatggccacggcattggcctggtgatgccatcgatcattgcccagggcgtgccctgcgtggcggtggccagcaacgaagaggcccgcgtggttcgcgccagcggctttatcgggcaactggtgcgggtacgcctggccagcctcagcgagctggaagacgccctgcaatacgacatggaagaactggtcggcagcgccgagttcgcccgccaggtcgatgccatcgccgcgcgccacggcaagacgctgcgcatccacatggcgctcaactccagcggcatgagccgcaacggcgtagagatggccacctggtccggccgtggcgaagcgctgcagatcactgaccagaagcacctcaagctggtcgcgctgatgacccacttcgccgtggaagacaaggacgatgtgcgcaagggcctggcggcgttcaatgagcaggccgactggctgatcaagcacgccaagcttgaccgcagcaaggtcaccctgcacgcggccaactcgttcgctacgctggaggtgccggaagcgcgcctggacatggtgcgtaccggtggcgcgctgttcggtgacaccgtgccggcgcgcaccgaatacaaacgtgccatgcagttcaagtcgcacgtggcggcggtgcacagctacccggccggcaacaccgtcggctacgaccgcaccttcaccctggcccgcgattcgtgcctggccaacatcaccgtcggctactccgacggctgccgccgggtcctcaccaacaagggccatgtgctgatcaacggccatcgcgtgccggtggtgggcaaggtttcgatgaacacgctgatggtcgatgtcaccgacttcccggacgtgaagggtggcaacgaagtggtgctgtttggcaagcaggccgggtctgaaatcacccaggccgaaatggaagaaatcaacgatgcgctgctcgccgacctgtacaccgtgtggggcagtgccaacccgaaaattctcgtcgactag

SEQ ID NO: 432 - protein, 386 aa, Unknown
  Obtained from environmental sample
  DOMAIN (257)...(385): Alanine racemase, C-terminal domain
  misc_feature (1)..(386): Xaa is any amino acid
MAPPLSMDNGTNALTVQNSNAWVEVSASALQHNIRTLQTELGGKSKLCAVLKADAYGHGIGLVMPSIIAQGVPCVAVASNEEARVVRASGFIGQLVRVRLASLSELEDALQYDMEELVGSAEFARQVDAIAARHGKTLRIHMALNSSGMSRNGVEMATWSGRGEALQITDQKHLKLVALMTHFAVEDKDDVRKGLAAFNEQADWLIKHAKLDRSKVTLHAANSFATLEVPEARLDMVRTGGALFGDTVPARTEYKRAMQFKSHVAAVHSYPAGNTVGYDRTFTLARDSCLANITVGYSDGCRRVLTNKGHVLINGHRVPVVGKVSMNTLMVDVTDFPDVKGGNEVVLFGKQAGSEITQAEMEEINDALLADLYTVWGSANPKILVD

SEQ ID NO: 433 - DNA, 1164 bp, Unknown
  Obtained from environmental sample
  misc_feature (1)..(1164): n is a, c, g, or t
atggctccgccgatgtcgctggacaacggcacttcgcagctgaccgcgcaggtcagcaacgcctgggtggagatcaacaagactgccttcgagcacaacatccgcaccctgcaggcggagctcggtggcaagtcgaagctgtgcgcggtgctcaaggcggatgcctacggccacggcatcggcctgctgatgccgtcggtgatcgccatggacgtgccctgcgtcgccatcgccagcaacgaagaagcgcgggtggtgcgggccagcggcttcaagggcgaactggtgcgggtacgtaccggcttcctggcggaagtcgaggatgccctcaagtacaacgtcgaggaactggtcggcaatgccgagttcgcccaccaggcgggcgagattgccgcgcgtcaaggccgcaagctgcgtgtgcacatcgcgttgaactccagcggcatgagtcgcaacgggctggaaatggaaagcgagcaaggtcgccgcgacgccgtggccgttgcgaaggaaaagaacctcgaagtggtggcgatcatgacccactacgcagtggaggatcgcgaggatgtgctgaagggactggcggcgttcaaccggcaggccgactggctgatcaaggaagctggactggaccgcagcaagctgaccctgcacaccgccaactccttcgccaccctggaagtccccgaggcgcgcctggacatggtgcgtactggcggtgcgctgttcggcgacaccgtggtcacccgcaccgagtacaagcgggtgatgcagttcaagtcgcacgtggcttcggtgaacgcctacccggcgggcaacagcgtcggctatgaccgcacctacaccatcaaccgcgactcgcggctggccaacatcaccgtcggctactccgatggctaccggcgggtattcaccaacaagggccatgtgctgatcgacggccaccgcgtgccggtggtgggcaaggtttcgatgaacaccctgatggtcgacgtcaccgacttcccggacgtgaaggccggcgacgaagtggtgctgttcggcaagcagggcggcagcgagattgcccagagcgagatggaagacatcaatggtgcgctgctggccgacctgtacacggtctggggcagcgccaatccgaaagtgctggtcgagcaatag

SEQ ID NO: 434 - protein, 387 aa, Unknown
  Obtained from environmental sample
  DOMAIN (20)...(249): Alanine racemase, N-terminal domain
  misc_feature (1)..(387): Xaa is any amino acid
MAPPMSLDNGTSQLTAQVSNAWVEINKTAFEHNIRTLQAELGGKSKLCAVLKADAYGHGIGLLMPSVIAMDVPCVAIASNEEARVVRASGFKGELVRVRTGFLAEVEDALKYNVEELVGNAEFAHQAGEIAARQGRKLRVHIALNSSGMSRNGLEMESEQGRRDAVAVAKEKNLEVVAIMTHYAVEDREDVLKGLAAFNRQADWLIKEAGLDRSKLTLHTANSFATLEVPEARLDMVRTGGALFGDTVVTRTEYKRVMQFKSHVASVNAYPAGNSVGYDRTYTINRDSRLANITVGYSDGYRRVFTNKGHVLIDGHRVPVVGKVSMNTLMVDVTDFPDVKAGDEVVLFGKQGGSEIAQSEMEDINGALLADLYTVWGSANPKVLVEQ

SEQ ID NO: 435 - DNA, 1167 bp, Unknown
  Obtained from environmental sample
  misc_feature (1)..(1167): n is a, c, g, or t
atggctccctatctgcccctggccagcgacacccgcaacggtcaggagcagaccgccgccaacgcctggctggaggtggacttgaccgccttcgagcacaacatccagaccctcaaggatcgtctcggcgacaagggcccgcagatctgcgccatcatgaaggccgacacctacggtcacggcatcgatctgctggtcccctccgtggtcaaggcgggcattccctgcatcggcatcgccagcaatgaagaggcccgcgtggcccgcgagaagggcttcgagggccgcctgatgcgggtccgtgccgccaccccggccgaagtggagcaggccctgccctacaagctggaagagctggtcggcagcctggagagcgccaaggggatcgccgacatcgcccagcgcaaccataccaacattccggtgcacataggtctgaactccgccggcatgagccgcaacggcatcgacctgcgccaggcaaacgccaaggaagatgccctggccatggtcaagctcaaggggatcaccccggtcggcatcatgacccacttcccggtggaagagaaagaggacgtcaagctggggctggcccagttcaagctggactaccagtggctgatcgatgcgggcaagctggatcgcagcaagctcaccatacacgccgccaactccttcgccaccctggaagtgccggaagcctactttgacatggttcgcccgggcggcatcatctacggtgacaccatcccctcctacaccgaatacaagaaggtgatggcgttcaagacccaggtcgcctcggtaaaccactacccggcgggcaacaccgtcggctatgaccgcaccttcaccctcaagcgtgactccctgctcgccaacctgccgctgggttactccgacggctaccgccgtgcgctgagcaacaaggcctatgtgctgatccagggccagaaggtgcccgtggtgggcaagacctccatgaacaccatcatggtggacgtgaccgatctcaaaggggtgaaacccggtgacgaggtggtgctgttcggccgtcagggtgaggccgaggtgaagcaggcggatctggaggagtacaacggcgccctgctggcggacatgtacaccatctggggttacaccaaccccaagaagatcaagcgctaa

SEQ ID NO: 436 - protein, 388 aa, Unknown
  Obtained from environmental sample
  DOMAIN (259)...(387): Alanine racemase, C-terminal domain
  misc_feature (1)..(388): Xaa is any amino acid
MAPYLPLASDTRNGQEQTAANAWLEVDLTAFEHNIQTLKDRLGDKGPQICAIMKADTYGHGIDLLVPSVVKAGIPCIGIASNEEARVAREKGFEGRLMRVRAATPAEVEQALPYKLEELVGSLESAKGIADIAQRNHTNIPVHIGLNSAGMSRNGIDLRQANAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 437 - DNA, 714 bp, Unknown
  Obtained from environmental sample
  misc_feature (1)..(714): n is a, c, g, or t
atgaaaaataacaaatgtatagcaattcttggtggtatgggacctcaagcttcatcaaagcttttagaggtcatgatttctatggcaacaaaggattttggaattaaaaatgattcagattttcctgaaataattcttgattcaatacctgttcccaacttcatatctaataaggaaaactctaaaccagccttagatgtactcagaagtagagtgaagaggttggaagtttttgagccattttcttttgcaattgcttgcaatacggctcacttactattaaatgaccttcaaaaaacgactagagttccttttatatccattattgagcaagttgcaaataaagtaagtgagaagagaattaagaaagttggattattagcaactcccatcacgattgaatcaaatctttaccagtccatgctcaaaaaacataaagtcgaagtaattgatcctacaaaaatggatagaattaagctggatacaataatcagaagagtaattgcaggtaaaaccaagcctatagattctctcatgcttcttgtcattgctaaaaaattaaaaagcaaaggcgcagaaggaataattcttggatgtacagaaatacctttaatcttcccaaaagataggtttgaaatccccatttttgattctgttgaaatactagccgaagcattattgcaaaaaatggtgaaaggaggtgaatatatatag

SEQ ID NO: 438 - protein, 237 aa, Unknown; identical to SEQ ID NO: 104
  Obtained from environmental sample
  SIGNAL (1)...(19)
  DOMAIN (6)...(231): Asp/Glu/Hydantoin racemase
  misc_feature (1)..(237): Xaa is any amino acid

SEQ ID NO: 439 - DNA, 1095 bp, Unknown
  Obtained from environmental sample
  misc_feature (1)..(1095): n is a, c, g, or t
atggctagcaatgcctgggtggagatagacctgggtgcgtttgagcacaacctccagaccctcaagacccgcctcggcgacaagggaccgcagatctgcgccatcatgaaggccgatgcctacggtcacggcatcgatctgctggtcccctccgtggtcaaggcgggcatcccctgcatcggcatcgccagcaatgaagaggcccgcgtcgcccgcgagaagggcttcgaaggccgcctgatgcgggtgcgcgccgccaccccggatgaagtggagcaggccctgccctatcggctggaagagctggtgggcagcctggtgagcgcccaagggatctccgacatcgcattgcgtcacaacacccggatcccggtgcacatcggcctcaactccgccggcatgagccgcaacggcatcgacctgagggccgaggatgccaagggcgaggccctctccatgctggcgctcaaggggatcaccccggtcggcatcatgacccacttcccggtggaggagaaagaggacgtcaagctggggctggcccagttcaagctggacacccagtggctcatcgaggcgggcaagctggatcgcagcaagctcaccatccacgccgccaactccttcgccactctggagctgccggaagcctactttgacatggtgcgcccgggcggcatcatctatggcgataccatcccctcctacaccgaatacaagaaggtgatggcgttcaagacccaggtcgcctcggtcaaccgctacccggcgggcaactccgtcggttatgaccgcaccttcaccctcaagcgcgatgccctgctcgccaacctgcccctgggttactccgacggctatcgccgcgcgctgagcaacaaggcctatgtgctgatccagggccagaaggcgcccgtggtgggcaagacctccatgaacaccgtcatggtggacgtgaccgacatcaagggggtcaaacccggtgacgaggtggtactgttcggccgccagggggaagccgaggtgaggcagggggatctggaggagtacaacggcgccctgctggcggacatgtacaccgtctggggcaacacctaa

SEQ ID NO: 440 - protein, 364 aa, Unknown
  Obtained from environmental sample
  DOMAIN (242)...(359): Alanine racemase, C-terminal domain
  misc_feature (1)..(364): Xaa is any amino acid
MASNAWVEIDLGAFEHNLQTLKTRLGDKGPQICAIMKADAYGHGIDLLVPSVVKAGIPCIGIASNEEARVAREKGFEGRLMRVRAATPDEVEQALPYRLEELVGSLVSAQGISDIALRHNTRIPVHIGLNSAGMSRNGIDLRAEDAKGEALSMLALKGITPVGIMTHFPVEEKEDVKLGLAQFKLDTQWLIEAGKLDRSKLTIHAANSFATLELPEAYFDMVRPGGIIYGDTIPSYTEYKKVMAFKTQVASVNRYPAGNSVGYDRTFTLKRDALLANLPLGYSDGYRRALSNKAYVLIQGQKAPVVGKTSMNTVMVDVTDIKGVKPGDEVVLFGRQGEAEVRQGDLEEYNGALLADMYTVWGNT

SEQ ID NO: 441 - DNA, 1167 bp, Unknown
  Obtained from environmental sample
  misc_feature (1)..(1167): n is a, c, g, or t
atggctccctatctgccgctggcaagcgatcatcgcaacggcgaagtacaaaccgccagcaacgcctggctggaagtagacctgaccgcgtttgaacagaatctgcagaccctcaagacccgcctcggcgacaagggcccgcagatctgcgccatcatgaaggccgacgcctacggtcacggcatcgatctgctggtcccctccgtggtcaaggcaggcattccctgcatcggcatcgccagcaatgaagaggcccgcgtggcccgcgagaagggcttcgagggccgcctgatgcgggtccgtgcagccaccccggccgaagtggaacaggccctgccctacaagctggaagagctggtgggcagcctggagagcgccaaggggatcgccgacatcgcccagcgccaccataccaccattccggtgcacataggtctgaactccgccggcatgagccgcaacggcatcgacctgcgccaggcggacgccaaggaagatgccctggccatggtcaagctcaaggggatcaccccggtcggcatcatgacccacttcccggtggaggagaaagaggacgtcaagctggggctggcccagttcaagctggactaccagtggctgatcgatgcgggcaagctggatcgcagcaagctcaccatacacgccgccaactccttcgccaccctggaagtgccggaagcctactttgacatggtacgcccgggcggcatcatctacggtgacaccatcccctcctacaccgaatacaagaaggtgatggcgttcaagacccaggtcgcctcggtgaaccactacccggcgggcaacaccgtcggctatgaccgcaccttcaccctcaagcgtgactccctgctcgccaacctgccgctgggttactccgacggctaccgccgtgcgctgagcaacaaggcctatgtgctgatccagggccagaaggtgcccgtggtgggcaagacctccatgaacaccatcatggtggacgtaaccgatctcaaaggggtgaaacccggtgatgaagtggtgctgttcggccgtcagggtgaggccgaggtgaagcaggcggatctggaggagtacaacggcgccctgctggcggacatgtacaccatctggggttacaccaaccccaagaagatcaaacgctag

SEQ ID NO: 442 - protein, 388 aa, Unknown
  Obtained from environmental sample
  DOMAIN (259)...(387): Alanine racemase, C-terminal domain
  misc_feature (1)..(388): Xaa is any amino acid
MAPYLPLASDHRNGEVQTASNAWLEVDLTAFEQNLQTLKTRLGDKGPQICAIMKADAYGHGIDLLVPSVVKAGIPCIGIASNEEARVAREKGFEGRLMRVRAATPAEVEQALPYKLEELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 443 - DNA, 1167 bp, Unknown
  Obtained from environmental sample
  misc_feature (1)..(1167): n is a, c, g, or t
atggctccctacctgccgctcgccagcgacacccgcaacggtcaggagcagaccgccgccaacgcctggctggaggtggacttgaccgccttcgagcacaacatccagaccctcaaggatcgtctcggcgacaagggcccgcagatctgcgccatcatgaaggcggacgcctacggccacggcatcgatctgctggtgccctccgtggtcaaggcgggcattccctgcatcggcatcgccagcaatgaagaggcccgcgtggcccgcgagaagggcttcgagggccgcctgatgcgggtccgtgccgccaccccggttgaggtagagcaggcgctgccctacaagctggaagagctggtaggcagcctggagagcgccaaggggatcgccgacatcgcccagcgccaccataccaccattccggtgcacataggtctgaactccgccggcatgagccgcaacggcatcgacctgcgccaggcggacgccaaggaagatgccctggccatggtcaagctcaaggggatcaccccggtcggcatcatgacccacttcccggtggaagagaaagaggacgtcaagctggggctggcccagttcaagctggactaccagtggctgatcgacgcgggcaagctggatcgcagcaagctcaccatacacgcagccaactccttcgccaccctggaagtgccggacgcctactttgacatggtacgcccgggcggcatcatctacggtgacaccatcccctcctacaccgaatacaagaaggtgatggcgttcaagacccaggtcgcctcggtgaatcactacccggcgggcaacaccgtcggctatgaccgcaccttcaccctcaagcgcgactccctgctcgccaacctgccgctgggttactccgacggctaccgccgtgcgctcagcaacaaggcctatgtgctgatccagggccagaaggtgcccgtggtgggcaagacctccatgaacaccatcatggtggacgtgaccgacctcaaaggggtgaaacccggtgatgaagtggtgctgtttggccgtcagggtgaggccgaggtgaagcaggcggatctggaggagtacaacggcgccctgctggcggacatgtacaccatctggggttacaccaaccccaagaagatcaatcgctag

SEQ ID NO: 444 - protein, 388 aa, Unknown
  Obtained from environmental sample
  DOMAIN (259)...(376): Alanine racemase, C-terminal domain
  misc_feature (1)..(388): Xaa is any amino acid
MAPYLPLASDTRNGQEQTAANAWLEVDLTAFEHNIQTLKDRLGDKGPQICAIMKADAYGHGIDLLVPSVVKAGIPCIGIASNEEARVAREKGFEGRLMRVRAATPVEVEQALPYKLEELVGSLESAKGIADIAQRHHTTIPVHIGLNSAGMSRNGIDLRQADAKEDALAMVKLKGITPVGIMTHFPVEEKEDVKLGLAQFKLDYQWLIDAGKLDRSKLTIHAANSFATLEVPDAYFDMVRPGGIIYGDTIPSYTEYKKVMAFKTQVASVNHYPAGNTVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 445 - DNA, 1167 bp, Unknown
  Obtained from environmental sample
  misc_feature (1)..(1167): n is a, c, g, or t
atggctccctatctgcctctggcaagcgatcatcgcaacggcgaagtacaaaccgccagcaacgcctggctggaagtagacctgaccgcgtttgaacagaatctgcagaccctcaagacccgcctcggcgacaagggcccgcagatctgcgccatcatgaaggcggacgcctacggtcacggcatcgacctgctggttttttccgtcatcaaggccgagatcccctgtatcggcatcgccagcaacgaagaggcccgcgtcgctcgcgagaaaggctttaccggccgcctgatgcgggtgcgcgccgccactcctgtcgaagtggaacaggccctgccctacaagctggaagagctggttggcagcctggtgagtgctcaggggatctccgatatcgccctgcgccacaatacccggatcccggtgcatattggcctcaattccgccggcatgagccgcaacggcatagacctgcgtctgaccgatgccaagcaggatgcgctggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggaggcctactttgacatggtgcgcccgggcggcctcatctacggcgactccatcccctcctacaccgaatacagacgggtgatggcattcaagacccaggtggcgtcggttaaccactatccggcaggcaactccgtcggctatgaccgcacctttaccctcaagcgtgactccctgctcgccaacctgccgctcggttactccgacggctatcgccgagcgctgagcaacaaggcctatgtactgatccagggtcagaaggtacctgtggtgggcaagacctccatgaacaccatcatggtggacgtgaccgatctcaaaggggtaaagcccggtgatgaagtggtgctgtttggccgtcagggtgaggccgaagtgaaacaggccgatctcgaggagtacaacggtgccctgctggcggacatgtacaccatctggggctacaccaaccccaagaagatcaaacgctag

SEQ ID NO: 446 - protein, 388 aa, Unknown
  Obtained from environmental sample
  DOMAIN (259)...(387): Alanine racemase, C-terminal domain
  misc_feature (1)..(388): Xaa is any amino acid
MAPYLPLASDHRNGEVQTASNAWLEVDLTAFEQNLQTLKTRLGDKGPQICAIMKADAYGHGIDLLVFSVIKAEIPCIGIASNEEARVAREKGFTGRLMRVRAATPVEVEQALPYKLEELVGSLVSAQGISDIALRHNTRIPVHIGLNSAGMSRNGIDLRLTDAKQDALAMLKLKGITPVGIMTHFPVEEKEDVKLGLAQFKLDSQWLIEAGKLDRSKLTIHAANSFATLEVPEAYFDMVRPGGLIYGDSIPSYTEYRRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKIKR

SEQ ID NO: 447 - DNA, 1167 bp, Unknown
  Obtained from environmental sample
  misc_feature (1)..(1167): n is a, c, g, or t
atggctccctatctgccccttgcgacggatcatcgcagcggccaggagcaaaccgccagcaacgcttggttggaagtggatctgggcgcctttgaacacaatatccagaccctcaaggatcgtctcggtgacaagggcccgcagatctgcgccatcatgaaggccgacgcttatggtcatggcatcgacctgctggtcccctccgtggtcaaggccaatatcccctgcatcggcatcgccagcaacgaagaggcgcgcgtcgcccgcgagaagggctttactggccgtctgatgcgggtgcgtgctgccaccccggacgaagtagagcaggccctgccctacaagatggaggagctgatcggcagtctggtgagtgcccaaggtatcgccgagatcgcccagcgccaccacaccaccattccggtgcatattgcgctcaactccgccggcatgagccgcaacggcatcgacctgcgtctggccgatgccaagcaggatgcgctggccatgctcaagctaaaggggatcaccccggtcggcatcatgacccacttcccggttgaggagaaagaggacgtcaagatgggactggcccagttcaaactggactcccagtggctgctggaagcgggcaagctggatcgcagcaagatcaccatccacgccgccaactccttcgccaccctggccgtgccggacgcctacttcgacatggtgcgcccgggcggcctgctctacggtgactccatcccctcccacaccgaatacaagcgggtgatggcattcaagacccaggtcgcctcggtcaaccactttgcagcgggcaacaccgtcggttatgaccgcacctttaccctcaagcgtgactcctggctcgccaacctgccgctcggttactccgacggttatcgccgctccctgagcaacaaggcctatgtgctgatcaagggtcagaaggtgccggtggtcggcaagacctccatgaacaccatcatggtggacgtgaccgatctgaaaggggtcaaacccggtgacgaggtggtgctgtttggccgtcagggaagtgccgaggtgaaacaggcggatctggaggagtacaacggcgccctgctggcggacatgtacaccatctggggctacaccaaccccaagaagatcaatcgctag

SEQ ID NO: 448 - protein, 388 aa, Unknown
  Obtained from environmental sample
  DOMAIN (259)...(376): Alanine racemase, C-terminal domain
  misc_feature (1)..(388): Xaa is any amino acid
MAPYLPLATDHRSGQEQTASNAWLEVDLGAFEHNIQTLKDRLGDKGPQICAIMKADAYGHGIDLLVPSVVKANIPCIGIASNEEARVAREKGFTGRLMRVRAATPDEVEQALPYKMEELIGSLVSAQGIAEIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHFAAGNTVGYDRTFTLKRDSWLANLPLGYSDGYRRSLSNKAYVLIKGQKVPVVGKTSMNTIMVDVTDLKGVKPGDEVVLFGRQGSAEVKQADLEEYNGALLADMYTIWGYTNPKKINR

SEQ ID NO: 449 - DNA, 1167 bp, Unknown
  Obtained from environmental sample
  misc_feature (1)..(1167): n is a, c, g, or t
atggctccctatctgccccttgcgacggatcatcgcaacggccaggagcaaaccgccagcaacgcctggttggaagtggatctgggcgcctttgaacacaatatccagaccctcaaggatcgcctcggcgacaagggcccgcagatctgcgccatcatgaaggccgacgcttacggtcatggcatcgacctgctggtcccctccgtggtcaaggcaaatatcccctgcatcggcatcgccagcaacgaagaggcgcgcgtcgcccgcgagaagggctttaccggccgtctgatgcgggtgcgtgctgccaccccggatgaagtagagcaggccctgccctacaagatggaggagctgatcggcagtctggtcagtgcccagggtatcgccgatatcgcccagcgccaccacaccaccattccggtgcatattgcactcaactccgccggcatgagccgcaacggcatcgacctgcgtctggccgatgccaagcaggatgcgctggccatgctcaagctaaaggggatcaccccggtcggcatcatgacccacttcccggttgaggagaaagaggacgtcaagatgggactggcccagttcaaactggactcccagtggctgctggaagcgggcaagctggatcgcagcaagatcaccatccacgccgccaactccttcgccactctggccgtgccggacgcctacttcgacatggtgcgcccgggcggcctgctctacggtgactccatcccctcccacaccgaatacaagcgggtgatggcattcaagacccaggtcgcctcggtcaaccactatgcagcgggtaacaccgtcggttatgaccgtacctttaccctcaaacgtgactcctggctcgccaacctgccgctgggctactccgatggctatcgccgcgccctcagcaacaaagcctatgtgctgatccagggtcagaaggtaccggtggtcggcaagacctccatgaacaccatcatggtggacgtgaccgacctgaagggtgtgaaacccggtgacgaggtggtgctgtttggccgccagggtgacgccgaagtgaaacaggcggatctggaggagtacaacggcgccctgctggcggacatgtacaccatctggggctacaccaaccccaagaagatcaaacgctag

SEQ ID NO: 450 - protein, 388 aa, Unknown
  Obtained from environmental sample
  DOMAIN (259)...(387): Alanine racemase, C-terminal domain
  misc_feature (1)..(388): Xaa is any amino acid
MAPYLPLATDHRNGQEQTASNAWLEVDLGAFEHNIQTLKDRLGDKGPQICAIMKADAYGHGIDLLVPSVVKANIPCIGIASNEEARVAREKGFTGRLMRVRAATPDEVEQALPYKMEELIGSLVSAQGIADIAQRHHTTIPVHIALNSAGMSRNGIDLRLADAKQDALAMLKLKGITPVGIMTHFPVEEKEDVKMGLAQFKLDSQWLLEAGKLDRSKITIHAANSFATLAVPDAYFDMVRPGGLLYGDSIPSHTEYKRVMAFKTQVASVNHYAAGNTVGYDRTFTLKRDSWLANLPLGYSDGYRRALSNKAYVLIQGQKVPVVGKTSMNTIMVDVTDLKGVKPGDEVVLFGRQGDAEVKQADLEEYNGALLADMYTIWGYTNPKKIKR

SEQ ID NO: 451 - DNA, 1167 bp, Unknown
  Obtained from environmental sample
  misc_feature (1)..(1167): n is a, c, g, or t
atggctccctatctgccgcaggcgagcgatcatcgcaacggcgaagtacaaaccgccagcaacgcctggttggaagtggatctgggcgccttcgaacacaatatccagaccctcaaggatcgcctcggtgacaagggtccgcagatctgcgccatcatgaaggccgacgcctacggtcatggcatcgacctgctggtcccctccgtggtcaaggccaatatcccctgtatcggcatcgccagcaacgaagaggcccgcgtcgctcgcgagaaggggtttaccggtcgcctgatgcgggtgcgcgccgccactcctgtcgaagtggaacaggccctgccctacaagctggaagagctggttggcagcctggtgagtgctcaggggatctcagacatcgccctgcgccacaatacccggatcccggtgcatattggcctcaactccgccggcatgagccgcaacggcatagacctgcgtctggccgattccaaacaagatgcgctgaccatgctcaagctcaaggggatcaccccggtcggcatcatgacccacttcccggtagaggagaaagaggacgtcaagatggggctggcccagttcaaactggactcccagtggctgctggaagcgggcaagctggatcgcagcaagatcaccatccacgccgccaactccttcgccaccctggaagtgccggatgcctacttcgacatggtgcgcccgggtggcctgctctacggcgactccatcccctcctacaccgaatacaagcgggtgatggcattcaagacccaggtcgcctcggtcaaccactacccggcaggcaactccgtcggctatgaccgcacctttaccctcaaacgtgactccctgctcgccaacctgccgctcggttactccgacggctatcgccgtgcgctgagcaacaaggcctatgtactgatccagggtcagaaggtacctgtggtgggcaagacctccatgaacaccatcatggtggacgtgaccgatctcaaaggggtgaaacccggtgatgaagtggtgctgtttggccgtcagggtgaggccgaagtgaaacaggccgatctggaggagtacaacggtgccctgctggcggacatgtacaccatctggggctacaccaaccccaagaagatcaatcgctag

SEQ ID NO: 452 - protein, 388 aa, Unknown
  Obtained from environmental sample
  DOMAIN (259)...(376): Alanine racemase, C-terminal domain
  misc_feature (1)..(388): Xaa is any amino acid
MAPYLPQASDHRNGEVQTASNAWLEVDLGAFEHNIQTLKDRLGDKGPQICAIMKADAYGHGIDLLVPSVVKANIPCIGIASNEEARVAREKGFTGRLMRVRAATPVEVEQALPYKLEELVGSLVSAQGISDIALRHNTRIPVHIGLNSAGMSRNGIDLRLADSKQDALTMLKLKGITPVGIMTHFPVEEKEDVKMGLAQFKLDSQWLLEAGKLDRSKITIHAANSFATLEVPDAYFDMVRPGGLLYGDSIPSYTEYKRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 453 - DNA, 1167 bp, Unknown
  Obtained from environmental sample
  misc_feature (1)..(1167): n is a, c, g, or t
atggctccctatctgccgcaggcgagcgatcatcgcaacggcgaagtacaaaccgccagcaacgcctggctggaagtagacctgaccgtgtttgaacagaacctgcagaccctcaagacccgccttggagacaagggcccgcagatctgcgccatcatgaaggcggatgcctacggtcacggcatcgatctgctggttccctccgtcatcaaggccgagatcccctgtatcggcatcgccagcaacgaagaggcccgcgtcgctcgcgagaagggctttaccggtcgcctgatgcgggtgcgcgccgccactcctgtcgaagtggaacaggccctgccctacaagctggaagagctggttggcagcctggtgagtgctcaggggatctccgacatcgccctgcgccacaatacccggatcccggtgcatattggcctcaactccgccggcatgagccgcaacggcatagacctgcgtctggccgattccaagcaagatgcactggccatgctcaaactcaaggggatcaccccggtcggcatcatgacccacttcccggtggaggagaaagaggacgtcaagctggggctggcccagttcaagctggactcccagtggctgatcgaggcgggcaagctggatcgcagcaagctcaccatccacgcggccaactccttcgccaccctggaagtgccggacgcctactttgacatggtgcgcccgggcggcctgctctacggcgactccatcccctcttacaccgaatacaaacgggtgatggcattcaagacccaggtggcgtcggtcaaccactatccggcaggcaactccgtcggctatgaccgcacttttaccctcaagcgtgactccctgctcgccaacctgccgctcggttactccgacggctatcgccgtgcgctcagcaacaaggcctatgtactgatccagggtcagaaggtacctgtggtgggcaagacctccatgaacaccatcatggtggacgtgaccgacctcaaaggggtgaaacccggtgatgaagtggtgctgtttggccgtcagggtgaggccgaagtgaaacaggccgatctcgaggagtacaacggtgccctgctggcggacatgtacaccatttggggctacaccaaccccaagaagatcaaccgctag

SEQ ID NO: 454 - protein, 388 aa, Unknown
  Obtained from environmental sample
  DOMAIN (259)...(376): Alanine racemase, C-terminal domain
  misc_feature (1)..(388): Xaa is any amino acid
MAPYLPQASDHRNGEVQTASNAWLEVDLTVFEQNLQTLKTRLGDKGPQICAIMKADAYGHGIDLLVPSVIKAEIPCIGIASNEEARVAREKGFTGRLMRVRAATPVEVEQALPYKLEELVGSLVSAQGISDIALRHNTRIPVHIGLNSAGMSRNGIDLRLADSKQDALAMLKLKGITPVGIMTHFPVEEKEDVKLGLAQFKLDSQWLIEAGKLDRSKLTIHAANSFATLEVPDAYFDMVRPGGLLYGDSIPSYTEYKRVMAFKTQVASVNHYPAGNSVGYDRTFTLKRDSLLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 455 - DNA, 957 bp, Unknown
  Obtained from environmental sample
  misc_feature (1)..(957): n is a, c, g, or t
atgaacgacgttggtcccggcattcgggtagtggattcccataccgaaggggagcccactcgtgtcgtgtggagtggaggaccggatcttggtaaaggttcgttgcgcgaacgattgcaaagactccgggagaccgctgatgattttcggcgaactgtaatcctcgaacctcgcggatccgaggcgttggtgggagcgttgctgtgcgaaccggtggacgcaacttgtgcggcgggcgtcatctacttcaacaatgcgggctacctcggcatgtgcggtcacggaacgattggcgttgccgtcacactcgcatatttgggcaagattggaatcggaacccatcgcctggagacaccggttggagttgtcgaggtgaagctgctttcggcaaatgaagtctgcatcgaaaacgtgccgagctatcgctatcgctcaaaggtggctgtcgaggtggcgtctctcggcacagtggttggcgacattgcctggggcgggaattggttctttctcgtcgaaaagtcgccgtttgaattgaccgccgaaaatatccgcccgctcaacgatgcctgccatgaagtgcggatggctttgcgtcatcagcagatcaccggagctgacggtgccgagatcgatcatgtcgaattcttcggtccggctcagtccgacggcggtcatagccggaactttgtatattgccccggcggagcgttcgatcgctctccgtgtggaaccggaaccagcgcgaagatcgcctgtctggcggcggacggcaaactcaagccgggtgatcgttggattcaagagagcatcatcggtagcagattcacggcttcgtaccgcgaggactctgaggggcgaatcatcccatcggtttcagggcgcgcgtacatttgcgcggagtcgactctggttcaacaatcggatgatccctttcgcaacggtattgctattggatag

SEQ ID NO: 456 - protein, 318 aa, Unknown; identical to SEQ ID NO: 130
  Obtained from environmental sample
  DOMAIN (5)...(301): Phenazine biosynthesis-like protein
  misc_feature (1)..(318): Xaa is any amino acid

SEQ ID NO: 457 - DNA, 1074 bp, Unknown
  Obtained from environmental sample
  misc_feature (1)..(1074): n is a, c, g, or t
atggctcgggtggtcttgcggtgggcgcgctcggcgtacatccgcatcaccaccggatcgcacgcgctgttcgccgatgcgacgctcgccgacgtcgaacgcgctggcgcgaacgcaggcccgcaactcgccgacacgcaacccgacgacgtcgccgcgatcctgttcaccagcggctccaccggcgtgccgaagggcgtggtgtatcgccatcggcatttcgccgcgcagatcgacatgttgcgcgatgcgttcgggctcgcgcccggtggcgtcgacttgccgacgttcccgccgttcgcgctgttcgatccggcgctgggcgtgacctcgatcattcccgacatggatccctacgacaaggcctgccacttcgggctgattttcttcaacaacgtcggctacctcggcatgtgcgggcacggcctgatcggcgccatcgtggcgctggcccacgccgggctggtgaagccgggcctggtgcgcatcgacacgccggccggttacatcgcggccgtgctcggcgccaacggcgaggtcaccttcgacaacgtgccgagctaccgcaaacagcaggagatcgagctctacctgcctggcatcggcaacgtgccctgcgacatcgcctggggcggcaactggttttgcctaatcgagcagcacgagcagaaactcgagctggcgaacgtggccaagctcaccgactactgcctgcgcgtgcgccaggcggtcgccgacaccggtttccccgaggtggaccacgtcgagctgttcgggccgtcgcccacgccgggcgtgaacagccggagcttcgtgctctgcccgggcggcgcctatgaccgctcgccgtgcggcacgggcaccagtgcgaagctggcctgcctcgcggccgacaacaaactggctcccggcgccgagtgggtgcaggagagcatcgtcggcagcaccttccgcgcgaaataccgtcggcagggcgacaagatcgtcccgaccatcgccggcacggcccacgtgacctcggaggcgacgctgctgatcgatccggccgacccattcgcatgggggattcgatag

SEQ ID NO: 458 - protein, 357 aa, Unknown; identical to SEQ ID NO: 132
  Obtained from environmental sample
  SIGNAL (1)...(30)
  DOMAIN (55)...(357): Proline racemase
  misc_feature (1)..(357): Xaa is any amino acid

SEQ ID NO: 459 - DNA, 1167 bp, Unknown
  Obtained from environmental sample
  misc_feature (1)..(1167): n is a, c, g, or t
atggctccctacctgccgctcgccagcgacacccgcaacggtcaggagcaaaccgccgccaacgcctggctggaagtggatctgggcgccttcgagcacaacatccagaccctcaaggatcgcctcggtgacaagggcccgcagatctgcgccatcatgaaggcggacgcctacggtcacggcatcgatctgctggtgccctcggtggtcaaggccaacatcccctgcatcggcatcgccagcaacgaagaggcccgcgtggcccgcgagaagggctttaccggccgcctgatgcgggtgcgctctgccaccccggacgaagtggagcaggccctgccctacaagatggaagagctgatcggcagcctggtgagcgcccagggcatagccggcatcgcccagcgtcaccataccaatatcccggtgcacataggtctcaactccgccggcatgagccgcaacggcatagacctgcgtctggcggactccaaggccgatgcgctggccatgctcaagctcaaggggatcaccccggtcggcatcatgacccacttcccggtggaagagaaagaggacgtcaagctggggctggcccagttcaagctggactcccagtggctgatcgaggcgggcaagctggatcgcagcaagctcaccatccacgccgccaactccttcgccaccctggaagtgccggatgcctacttcaacatggtgcgcccgggcggcctgctctacggcgactccatcccctcctacaccgaatacaagcgggtcatggcgttcaagacccaggtcgcctccgtcaaccactacccggccggcaataccgtcggttatgaccgcaccttcaccctcaagcgcgactcctggctcgccaacctgccgctgggttactccgacggctaccgccgtgcactcagcaacaaggcctatgtgctggtccagggtcagaaagtgcccgtggtcggcaagacctccatgaacaccatcatggtggacgtgaccgatctgaaaggggtgaaacccggcgacgaggtggtgctgtttggccgtcagggcgaggccgaggtgaagcaggcggatctggaggagtacaacggcgccctgctggcggacatgtacaccatctggggctacaccaaccccaagaagatcaaccgctaa

SEQ ID NO: 460 - protein, 388 aa, Unknown
  Obtained from environmental sample
  DOMAIN (259)...(376): Alanine racemase, C-terminal domain
  misc_feature (1)..(388): Xaa is any amino acid
MAPYLPLASDTRNGQEQTAANAWLEVDLGAFEHNIQTLKDRLGDKGPQICAIMKADAYGHGIDLLVPSVVKANIPCIGIASNEEARVAREKGFTGRLMRVRSATPDEVEQALPYKMEELIGSLVSAQGIAGIAQRHHTNIPVHIGLNSAGMSRNGIDLRLADSKADALAMLKLKGITPVGIMTHFPVEEKEDVKLGLAQFKLDSQWLIEAGKLDRSKLTIHAANSFATLEVPDAYFNMVRPGGLLYGDSIPSYTEYKRVMAFKTQVASVNHYPAGNTVGYDRTFTLKRDSWLANLPLGYSDGYRRALSNKAYVLVQGQKVPVVGKTSMNTIMVDVTDLKGVKPGDEVVLFGRQGEAEVKQADLEEYNGALLADMYTIWGYTNPKKINR

SEQ ID NO: 461 - DNA, 1092 bp, Unknown
  Obtained from environmental sample
  misc_feature (1)..(1092): n is a, c, g, or t
atggctagcaacgcctgggttgaggtcaacaaggccgcattcgagcacaacattcgcaccctgcaagccgagctggacggcaagtcgaagctttgcgcagtgctcaaggccgacgcctacggtcacggcattggcttgctgatgccctcggtgattgcgctgggcgtgccctgcgtggcgatcgccagcaacgaagaggcgcgcgtggtgcgcgagagtggcttcaagggtcagttgatccgggtccgtcagggggctttgagcgagatcgacaatgccttgcagtacaacgtcgaagagctggtgggcaacctcgacctcgctcgccaagcagctgaggtggcgcagaagcaggggcgcaagttgcaggtgcacatcgccctcaactccagtggcatgagccgtaacggcctggaaatgaacagcgaacagggcaagcaggacgccctggcgatcacccagctgccgaacgtcgaagtgctggcgataatgacccactacgcagtggaagagcgcgaggacgtgctcaagggcttggccgcgttcaaggaacagtccgcctggctgatggacaaggcgcagctcgaccgcagcaagatcactctgcacaccgccaactccttcgccaccctggaagtgcccgaggcgcggttggacatggtgcgtaccggcggcgcgctgtttggcgacactgtcatcgagcgcaccgaatacaagaaggtcatgcagttcaagtcgcacgtggcctcggtcaacagctacccggccggcaacaccgtcggttacgaccgcacctacaccctggcgcgggattcgaagctggccaacatcaccgtcggctactccgatggctaccgccgggtgttcaccaataagggcatcgtgctgatcaatggtcaccgcgtgccggtggtcggcaaggtctcgatgaataccttgatggtcgatgtcaccgacgtcccgagcgtgcgcccaggcgatgaggtggtgctgttcggcaagcagggcgcggtggaaaccagccagacggaaatggaggaggccaacggtgcgctgctggccgacctgtacacggtctggggcagctcctaa

SEQ ID NO: 462 - protein, 363 aa, Unknown
  Obtained from environmental sample
  DOMAIN (241)...(358): Alanine racemase, C-terminal domain
  misc_feature (1)..(363): Xaa is any amino acid
MASNAWVEVNKAAFEHNIRTLQAELDGKSKLCAVLKADAYGHGIGLLMPSVIALGVPCVAIASNEEARVVRESGFKGQLIRVRQGALSEIDNALQYNVEELVGNLDLARQAAEVAQKQGRKLQVHIALNSSGMSRNGLEMNSEQGKQDALAITQLPNVEVLAIMTHYAVEEREDVLKGLAAFKEQSAWLMDKAQLDRSKITLHTANSFATLEVPEARLDMVRTGGALFGDTVIERTEYKKVMQFKSHVASVNSYPAGNTVGYDRTYTLARDSKLANITVGYSDGYRRVFTNKGIVLINGHRVPVVGKVSMNTLMVDVTDVPSVRPGDEVVLFGKQGAVETSQTEMEEANGALLADLYTVWGSS

SEQ ID NO: 463 - DNA, 1143 bp, Unknown
  Obtained from environmental sample
  misc_feature (1)..(1143): n is a, c, g, or t
atgagcgccgcggcgctgcgcgcgggcgcgatcctgacggtggacctcgatgcggtcgttgcgaactggcggctgctgtcgaagctggcgaaaagggccgaatgcgccgccgtggtcaaggcggacgcctacggcctcggcgcggggcgggtcggcgctgcccttcagacggcgggttgcaggaccttcttcgtcgcccatctcgaggaaggactcgaactccggaaggcgatcggcttcagttcgcgtgtcttcgtcctgaacggcacacctgcgggcaccgaaagcgagttcctcaactcggtcctgatcccggtcgtcaacacgtcgggagaactcgccgcctggcgcgatcatgcccgggagaagagacgcagcatgcctgtcgccctccagctcgacacgggtatgtcgcgcctcgggctgtcgcccggcgacgtggccgagctggcgggagagccgtttagccttggcggcctctccgtcgagctggtcatgagccatctcgcctgtgccgacgcgccggcgcaccctgccaaccgacggcagcggcgcgcgttcgccaagctccggacggttctgcccaggcgggcggcatcttcgctcgcgaactccgccggagttctcctagggccggagttccgcttcgacctggttcggccgggagcggcgctctacgggatcaacccggtccccggaggtccgaaccccttcagccaggccgtgacgctatcggcgcgcgtgcttcagattcgcgaggtgccagccgggaccagcgtcggctatggccacgcacgtacggtggagagacaaggccgcctcgcgacgctctcgctcggctacgcggacggctggccacgtgccgcgaacatgtccgccttctacaaggggcaaccgctacccttcgcggggcgcgtatcgatggacagcatcgtcgtcgatgcgactgactgcgccgaggcccctcgcgagggcgagttcgtaagtctcatcactcgagaacagaccgtggacgatgtcgcccgtgccgccggcacgatcggctatgagatcctcacccggctcggccgacgctttgcccgagattaccgtcaccacgcagcgctcgctgcctanagntctcatcaccatcaccatcactaa

SEQ ID NO: 464 - protein, 380 aa, Unknown
  Obtained from environmental sample
  DOMAIN (241)...(364): Alanine racemase, C-terminal domain
  misc_feature (1)..(380): Xaa is any amino acid
MSAAALRAGAILTVDLDAVVANWRLLSKLAKRAECAAVVKADAYGLGAGRVGAALQTAGCRTFFVAHLEEGLELRKAIGFSSRVFVLNGTPAGTESEFLNSVLIPVVNTSGELAAWRDHAREKRRSMPVALQLDTGMSRLGLSPGDVAELAGEPFSLGGLSVELVMSHLACADAPAHPANRRQRRAFAKLRTVLPRRAASSLANSAGVLLGPEFRFDLVRPGAALYGINPVPGGPNPFSQAVTLSARVLQIREVPAGTSVGYGHARTVERQGRLATLSLGYADGWPRAANMSAFYKGQPLPFAGRVSMDSIVVDATDCAEAPREGEFVSLITREQTVDDVARAAGTIGYEILTRLGRRFARDYRHHAALAAXXSHHHHHH

SEQ ID NO: 465 - DNA, 1002 bp, Unknown
  Obtained from environmental sample
  misc_feature (1)..(1002): n is a, c, g, or t
atgaaacaaacttttttttgtatagatgcacatacatgcggtaatccggtcaggttggttaaagaaggcgggccgctgttgacgggaaagaacatgagtgaaaagcggcagcatttcctgaaagaatatgactggataagaacaggattgatgtttgaaccaagaggtcatgatatgatgagcggaagcattttatacccgccacatgatccttcaaatgatgtagcagtattatttattgaaacaagcggatgcctgccaatgtgcggacatggaacgattggaacgataacgatcgctattgaagaaggattgatacagccgaaaacggaaggtgttgttagaatggaaacgccggcggggttagttaacgtagaattcaaaagtcaaaatgaaaaagtaaaaagcgtaaagcttaccaatgttccttcatttctttattcaacagatttagttgctgattgtcctgagctgggtgaattagttatcgatgtttcttacggtggaaatttttatgcaatcgttgatgtacaaaaaaattttaaagggcttgaacattatcctgctgataaattaattgcctgggcaagagagctgcggaagaatatcaatgcgaaatatgaatttgtacatcccgacgatccgacaatcaatcgttgttcgcatattttatggacgggagctgtaattgataaaacatcgaccgcacgtaatgcggtattttatggcgataaagcaatagatcgttcgccatgtggtacaggtacaagtgcaagaatggcgcaatggtatgcaaaaggaaaattaaaaaagggagatcagttcattcacgaaagtattatcggaagcaaattcatcggaacgattgaagaagaaacgatgataggagataagcccgctatacgtccgggaatagaaggctgggcaaagatatacggacgcaatacgataactatcgatactgaggatgatccgtatgctcatgggttccaggttatttag

SEQ ID NO: 466 - protein, 333 aa, Unknown; identical to SEQ ID NO: 106
  Obtained from environmental sample
  DOMAIN (7)...(331): Proline racemase
  misc_feature (1)..(333): Xaa is any amino acid

SEQ ID NO: 467 - DNA, 960 bp, Unknown
  Obtained from environmental sample
  misc_feature (1)..(960): n is a, c, g, or t
atgaacatcaacccgagcgttcgcgtcgttgattcccacacgggcggcgaacccacgcgcgtggttgtcagcggcgggcccgacttgggcagtggctcgatcgaatcccgcctgaaactttttcgcgagaaattcgattcgtttcgctccgccgtcatcaatgaaccgcgcgggtcggacattctggtcggcgcgctgctctgcgcgccggtcgatccatcgaacgcctgtggcgtgatctttttcaacaatgtcggctatcttggcatgtgcggacacggaaccatcgggctggtcgcgacgctcgcgtatctcaaaaagatcgcgcccggcgaacatcgcattgaaaccttcgtcggcaccgtcacggcgcgactgcatgagtcgggcgaagtctccgtgaaaaacgtgccgagctaccgtctgtccaaagatgttgccgttgatgtgaaggggctcggcacttttaccggtgacattgcttggggcggaaactggttctttctggtgaaacagccgcgcgaagatcttctactgaagaacgcggaaagcctgaccgaagccgcgtggaaaatccgccaggcgctcaccgagaaaggcatcaccggcagcgatggcggcgaaatcgatcacatcgaatttttcggcccgccgaaaacttctggcgccgacagccgcaattttgtgctctgccccggcaaggcgtacgaccgttcgccctgcggcacgggcacgagcgcgaagctggcgtgtctttttgcggacggaaaactgcggccgggccagacctggaagcaggagagcatcaccggtagcatatttacaggcagcgttgaagaagtcgccggaagtgttccgcacacggtgctgccgaccatccagggcagcgcgttcattaccggcgaaacggcgctgatttttgatccgcgggaccccttgaaactgggattgcgaacgtag

SEQ ID NO: 468 - protein, 319 aa, Unknown; identical to SEQ ID NO: 298
  Obtained from environmental sample
  DOMAIN (9)...(318): Proline racemase
  misc_feature (1)..(319): Xaa is any amino acid

SEQ ID NO: 469 - DNA, 939 bp, Unknown
  Obtained from environmental sample
  misc_feature (1)..(939): n is a, c, g, or t
atgttcaagctggcgcaagtgttcaccatttctcgtgggtcacgcacggaagcaaaagtgctgacggtgcgcatcgaggaagatggcgttgttggatggggcgaatgtgtgccttatgcgcgctatggcgagacgcttgagtcggtcacaaaagagatcgaaagcgtgcgtggtgatgtgaaccgtgaggggctgtacacgttgcccgctggtgcggcgcgcaatgcgctggattgtgcgctgtgggatcttgaggccaaaaagactggcaaaagagtttgggatctggccggattggccgcacctaagcctgaaatcaccgcctatactttgtcgctggacacgccaaaaaacatgcaagagcaggccgcaaaacatgcgttccgcccgctgctcaagattaaactgggcacgcctgacgatatggcgcgtttggaagctgtgcgcgctggtgcgccaaaatcgaccattattgtggatgccaacgaaggttggtcggctgcggtctatgctgatctggcgccacatcttgtgcggttgggcgtggccttggttgagcagcctttgccggcgggcgaggatgaggcgttgattggcatggatcggcctgtgcctgtttgtgcggacgaaagctgtcatgatcgcgccagcttggcggggctgaaaggcaaatatgatgtggtcaacatcaagctcgacaaaaccggcgggctgaccgaagcgttgcgcctgcgggatgcggcgttggctgagggctgtaaagtgatggtgggctgcatggtcgggtcgtctttggcgatggcaccggccacattggtggcccaaggcgcgatggtgacagaccttgacgggccgctgttgttggccgaagaccgtgaaaatccactgaagtttgatgatgccggagtgcatgcgccaagcgcagcactttggggctag

SEQ ID NO: 470 - protein, 312 aa, Unknown; identical to SEQ ID NO: 312
  Obtained from environmental sample
  DOMAIN (1)...(98): Mandelate racemase / muconate lactonizing enzyme, N-terminal domain
  misc_feature (1)..(312): Xaa is any amino acid

SEQ ID NO: 471 - DNA, 1074 bp, Unknown; identical to SEQ ID NO: 367
  Obtained from environmental sample
  misc_feature (1)..(1074): n is a, c, g, or t

SEQ ID NO: 472 - protein, 357 aa, Unknown; identical to SEQ ID NO: 368
  Obtained from environmental sample
  DOMAIN (232)...(355): Alanine racemase, C-terminal domain
  misc_feature (1)..(357): Xaa is any amino acid

SEQ ID NO: 473 - DNA, 1167 bp, Unknown
  Obtained from environmental sample
  misc_feature (1)..(1167): n is a, c, g, or t
atggctccctacctgccgctggcaaacgatcatcgcaatggcgacgtacaaaccgccagcaatgcctggctggaagtcgacctgaccgccttcgagcacaatatccagaccctcaaggatcgcctcggtgacaagggcccgcagatctgcgccatcatgaaggctgacgcatatggtcacggcatcgacctgctggtcccctccgtggtcaaggccaatatcccctgcatcggcattgccagcaacgaagaggctcgcgtggcgcgcgagaagggcttcaccggccgcctgatgcgagtgcgttcagccactccggacgaagtggagcaggccctgccctacaagatggaagagctgatcggcagcctggtgagcgcccagggcatcgccgacatcgcccagcgtcaccataccaatatcccggtgcacataggtctcaactccgccggcatgagccgcaacggcatcgacctgcgtctggcggactccaaggcagatgcgctggccatgctcaagctcaaggggatcacccctgtcggcatcatgacccacttcccggtggaagagaaagaggacgtcaagctgggactggcccagttcaagctggactcccagtggctgatcgaggcgggcaagctggatcgcagcaagctcaccatccacgcggccaactccttcgccaccctggaagtgccggacgcctacttcgacatggtgcgcccgggcggcctgctctacggtgactccatcccctcctacaccgaatacaagcgggtcatggcgttcaagacccaggtggcctcggtcaaccactacccggctggcaataccgtaggctatgaccgcaccttcactctcaaacgtgactcctggctcgccaacctgccgctgggatactccgacggctaccgccgtgcgctcagcaacaaggcctatgtgctgatccagggtcagaaagtgcctgtggtcggcaaaacctccatgaacaccatcatggtggacgtgaccgatctgaaaggggtgaagcccggcgatgaagtggtgctgtttggccgtcagggtgaggccgaggtgaagcaggcggatctggaggagtacaacggtgccctgctggcggatatgtacaccatctggggctacaccaaccccaagaagatcaaccgctaa

SEQ ID NO: 474 - protein, 388 aa, Unknown
  Obtained from environmental sample
  DOMAIN (259)...(376): Alanine racemase, C-terminal domain
  misc_feature (1)..(388): Xaa is any amino acid
MAPYLPLANDHRNGDVQTASNAWLEVDLTAFEHNIQTLKDRLGDKGPQICAIMKADAYGHGIDLLVPSVVKANIPCIGIASNEEARVAREKGFTGRLMRVRSATPDEVEQALPYKMEELIGSLVSAQGIADIAQRHHTNIPVHIGLNSAGMSRNGIDLRLADSKADALAMLKLKGITPVGIMTHFPVEEKEDVKLGLAQFKLDSQWLIEAGKLDRSKLTIHAANSFATLEVPDAYFDMVRPGGLLYGDSIPSYTEYKRVMAFKTQVASVNHYPAGNTVGYDRTFTLKRDSWLANLPLGYSDGYRRALSNKAYVLIQGQKVPVVGKTSMNTIMVDVTDLKGVKPGDEVVLFGRQGEAEVKQADLEEYNGALLADMYTIWGYTNPKKINR

SEQ ID NO: 475 - DNA, 1164 bp, Unknown
  Obtained from environmental sample
  misc_feature (1)..(1164): n is a, c, g, or t
atggctccgccgttgtcgatgagcaacggcaatacgattctgaccacacaaatcagcaacgcctggatcgaaatcaacaaggccgcattcgagcacaacattcgcaccctgcaagccgagctggacggcaagtcgaagctttgcgcagtgctcaaggccgacgcctacggtcacggcattggcttgctgatgccctcggtgattgcgctgggcgtgccctgcgtggcgatcgccagcaacgaagaggcgcgcgtggtgcgcgagagtggcttcaagggtcagttgatccgggtccgtcagggggctttgagcgagatcgacaatgccttgcagtacaacgtcgaagagctggtgggcaacctcgacctcgctcgccaagcagctgaggtggcgcagaagcaggggcgcaagttgcaggtgcacatcgccctcaactccagtggcatgagccgtaacggcctggaaatgaacagcgaacagggcaagcaggacgccctggcgatcacccagctgccgaacgtcgaagtgctggcgataatgacccactacgcagtggaagagcgcgaggacgtgctcaagggcttggccgcgttcaaggaacagtccgcctggctgatggacaaggcgcagctcgaccgcagcaagatcactctgcacaccgccaactccttcgccaccctggaagtgcccgaggcgcggttggacatggtgcgtaccggcggcgcgctgtttggcgacactgtcatcgagcgcaccgaatacaagaaggtcatgcagttcaagtcgcacgtggcctcggtcaacagctacccggccggcaacaccgtcggttacgaccgcacctacaccctggcgcgggattcgaagctggccaacatcaccgtcggctactccgatggctaccgccgggtgttcaccaataagggcatcgtgctgatcaatggtcaccgcgtgccggtggtcggcaaggtctcgatgaataccttgatggtcgatgtcaccgacgtcccgagcgtgcgcccaggcgatgaggtggtgctgttcggcaagcagggcgcggtggaaaccagccagacggaaatggaggaggccaacggtgcgctgctggccgacctgtacaccgtttggggcagcgccaacccgaagattctggtggataaataa

SEQ ID NO: 476 - protein, 387 aa, Unknown
  Obtained from environmental sample
  DOMAIN (257)...(385): Alanine racemase, C-terminal domain
  misc_feature (1)..(387): Xaa is any amino acid
MAPPLSMSNGNTILTTQISNAWIEINKAAFEHNIRTLQAELDGKSKLCAVLKADAYGHGIGLLMPSVIALGVPCVAIASNEEARVVRESGFKGQLIRVRQGALSEIDNALQYNVEELVGNLDLARQAAEVAQKQGRKLQVHIALNSSGMSRNGLEMNSEQGKQDALAITQLPNVEVLAIMTHYAVEEREDVLKGLAAFKEQSAWLMDKAQLDRSKITLHTANSFATLEVPEARLDMVRTGGALFGDTVIERTEYKKVMQFKSHVASVNSYPAGNTVGYDRTYTLARDSKLANITVGYSDGYRRVFTNKGIVLINGHRVPVVGKVSMNTLMVDVTDVPSVRPGDEVVLFGKQGAVETSQTEMEEANGALLADLYTVWGSANPKILVDK

SEQ ID NO: 477 - DNA, 1176 bp, Unknown
  Obtained from environmental sample
  misc_feature (1)..(1176): n is a, c, g, or t
atggctcccgaactgcccgttaccggcctggataccagcagtgcccagctcacttccgccaacgcctgggtggaagtcgatcaggcggcgttcgagcacaatattcgcaccttgcagaccctgctcgacggcaagtcgcagatctgtgccatcatgaaggccgacgcctacggccatggcatcgccaacctgatgccctcggtgatggccgccaatatcccctgcatcggcattaccagcaacgaagaagcccgagtggtgcgggaaagcggctatcaagggcgcatcatgcgggtacgcagcgccacgccggcggaagtaagcgatggtctgcaatacgagatggaagagctgttcggcgatatcgaggcggcccgccaggcggccgaggtggccaaggccgccggcaagaccctgcgttatcacctgggcctgaatgccggcggcatgagccgcaacggcctggaagtggcgaccgaagccggcaagcaggaagcccgcgagctgctggcgcaggagaatctggaactggtcggcattatgacccatttccagtatgaagacgcggacttcgtgcgcgccgggctggccaaattcaatgaacagtctaagtggctgatcgaagacggcaagctggatcgcagcaagctgaccctgcatgcggccaactccttcaccaccctggaagtgccggaagcccggctggatatggttcgccccggcggcatcatctatggcgacaccattccttcctataccgaatacaagaaggtgatgtcgttcaagacccgggtggcgtcggtcaacaactacccggccggcagcctggtgggctatgacggcacctataccctggagcgggattcactgctggccaacctgccgatgggctattccgacggttaccgccgggtgttcaccaacagggcctatgtggtggtcaacggccagcgggcgccggtggtgggcaaggtgtcgatgaacaccaccatgatcgatgtgaccgatattccgggcgtcaagccgggggatgaagtggtgctgttcggcaagcagggcggggcggaagtcacccagggcgagctggaagacgccaacggcgccctgctggcggacctgtacacggtgtggggcaactccaaccccaagatcctcaaacccgtggtcagccagtaa

SEQ ID NO: 478 - protein, 391 aa, Unknown
  Obtained from environmental sample
  DOMAIN (258)...(386): Alanine racemase, C-terminal domain
  misc_feature (1)..(391): Xaa is any amino acid
MAPELPVTGLDTSSAQLTSANAWVEVDQAAFEHNIRTLQTLLDGKSQICAIMKADAYGHGIANLMPSVMAANIPCIGITSNEEARVVRESGYQGRIMRVRSATPAEVSDGLQYEMEELFGDIEAARQAAEVAKAAGKTLRYHLGLNAGGMSRNGLEVATEAGKQEARELLAQENLELVGIMTHFQYEDADFVRAGLAKFNEQSKWLIEDGKLDRSKLTLHAANSFTTLEVPEARLDMVRPGGIIYGDTIPSYTEYKKVMSFKTRVASVNNYPAGSLVGYDGTYTLERDSLLANLPMGYSDGYRRVFTNRAYVVVNGQRAPVVGKVSMNTTMIDVTDIPGVKPGDEVVLFGKQGGAEVTQGELEDANGALLADLYTVWGNSNPKILKPVVSQ

SEQ ID NO: 479 - DNA, 1056 bp, Unknown
  Obtained from environmental sample
atgacggatggggtgcgttgtatgtggatgcgcggtggcacgtccaaagggggttatttcctggccgaggatttaccccgcgatgaggctgtacgtgacggctttctgatgtctgttatgggctcgccggatgcgcgccagattgatggcatgggcggtgctgatccgctgacgtctaaagtggcggtggtgaaacagtcgacccgtgcaggtgtggatgtggattatctgtttctgcaggtggtcgtggatcagccaattgtagccgatgcgcaaaattgcggaaatattctggctggggtggggccgtttgctattgagcggggtttggtcgcgccgcagcaaggggagaccgaagtcaccatttatatggagaatacgggtcaaattgcagtcgcgcgtgtggccacgccagcgggggttgtcaggtatcaaggcgacgcacagattgacggggttcccggcgcggcggcaccggtgacgattgctttcagcgacaccgcggggtcgtcctgtggcgcgttgctgcccacaggcaacatcaccgatatagtcgacggagtggctgtcacgatgatcgacaatggcatgccttgtgtggtgatccgcgcgcaagatatggggatcatcggtgatgaaacggccgagcagttggaggccaacaccgagttgcgtcaaaaattggaggccttgcgtctgctctgcgggccgatgatgaaccttggggatgtgcgcgaaaaaacgatacctaaaatgacgatgatcagcgcgccgcgcgcaggcggggcgatcgccacacgcacgtttattccgcatcgctgtcacaagacgattggtgtgctgggcgcagtcagcgtggccacggcctgtttgatgcgcggctccgtggcttttgagatggccgtgcggggcgagggggccaatcggtcgctgtccattgagcacccaagcggagaaatgacggtgatcgcgacattagacgatgctggggacgtggcagaggcggcgatcctgcggacggcgcgcaaattgatggatggagaggtttttgcatga

SEQ ID NO: 480 - protein, 351 aa, Unknown
  Obtained from environmental sample
  DOMAIN (5)...(351): Protein of unknown function (DUF453)
  SITE (182)...(185): N-glycosylation site. Prosite id = PS00001
  SITE (312)...(315): N-glycosylation site. Prosite id = PS00001
MTDGVRCMWMRGGTSKGGYFLAEDLPRDEAVRDGFLMSVMGSPDARQIDGMGGADPLTSKVAVVKQSTRAGVDVDYLFLQVVVDQPIVADAQNCGNILAGVGPFAIERGLVAPQQGETEVTIYMENTGQIAVARVATPAGVVRYQGDAQIDGVPGAAAPVTIAFSDTAGSSCGALLPTGNITDIVDGVAVTMIDNGMPCVVIRAQDMGIIGDETAEQLEANTELRQKLEALRLLCGPMMNLGDVREKTIPKMTMISAPRAGGAIATRTFIPHRCHKTIGVLGAVSVATACLMRGSVAFEMAVRGEGANRSLSIEHPSGEMTVIATLDDAGDVAEAAILRTARKLMDGEVFA

SEQ ID NO: 481 - DNA, 1086 bp, Unknown
  Obtained from environmental sample
  misc_feature (1)..(1086): n is a, c, g, or t
agcaatgcctgggtcgaagtggatcttgccgccttcgagcagaaccttcagaccctcaagacccgccttggcgacaagggcccgcagatatgcgccatcatgaaggcggatgcctatggtcacggcatcgatctgctggtgccctctgtggtcgccgccggcattccctgcattggcatcgccagcaacgaagaggccagggttgcacgggacaagggcttcaccggtcgtctgatgcgagtacgcgccgcgactccggccgaggttgagcaggcggtgccttacaagctcgaagagctggtcggcggcctggagaacgccaccctcatcagcgagatagcccagcgccaccagacccagatcccggtgcatatcggtctcaactcggcaggcatgagccgtaacggcctggatctgcgcgcccaggatgccaaaggggaggccctggccatacttggtctcaaggggatcaccccggtcggcatcatgacccacttcccggtggaggagaaagaggacgtcaagctgggtctggcccagttcaagctcgactcccaatggctgatcgaggcgggcaagctggatcgcagcaagctgaccctgcactgcgccaactccttcgcaaccctggaagtacccgaagcgcatctggacatggttcgcccgggcggcctcatctatggcgactccatcccctcctacaccgaatacaagcgggtcatggctttcaagagccaggtagcggcagtcagtcatttcccggcgggcaacacggtcggttacgatcgtaccttcaccctnnagcgggattccgtgctggccaacctgccgatgggctactcggacggctatcgccgcgccatgagcaacaaggcctctgtgctcatcaacggccagaaggccccggtggtgggcaagacctccatgaacaccgtcatggtcgatgtgaccgacatcaagggcgtcaagcccggtgacgaggtggtgatgtttggccgccagggagataacgagatcaaacaggcggatctggaagagtacaatggcgccctgctggcggacatgtacacggtctggggcagctcc

SEQ ID NO: 482 - protein, 362 aa, Unknown
  Obtained from environmental sample
  DOMAIN (2)...(233): Alanine racemase, N-terminal domain
  DOMAIN (240)...(357): Alanine racemase, C-terminal domain
  SITE (32)...(42): Alanine racemase pyridoxal-phosphate attachment site. Prosite id = PS00395
  SITE (107)...(110): N-glycosylation site. Prosite id = PS00001
  misc_feature (1)..(362): Xaa is any amino acid
SNAWVEVDLAAFEQNLQTLKTRLGDKGPQICAIMKADAYGHGIDLLVPSVVAAGIPCIGIASNEEARVARDKGFTGRLMRVRAATPAEVEQAVPYKLEELVGGLENATLISEIAQRHQTQIPVHIGLNSAGMSRNGLDLRAQDAKGEALAILGLKGITPVGIMTHFPVEEKEDVKLGLAQFKLDSQWLIEAGKLDRSKLTLHCANSFATLEVPEAHLDMVRPGGLIYGDSIPSYTEYKRVMAFKSQVAAVSHFPAGNTVGYDRTFTLXRDSVLANLPMGYSDGYRRAMSNKASVLINGQKAPVVGKTSMNTVMVDVTDIKGVKPGDEVVMFGRQGDNEIKQADLEEYNGALLADMYTVWGSS

SEQ ID NO: 483 - DNA, 1110 bp, Unknown
  Obtained from environmental sample
  misc_feature (1)..(1110): n is a, c, g, or t
atgcaggcgctgtgcgacgctgccggcgtgcgcctgcgggcgcatggcaagacccacaagtgttcgacgcttggccgtctgatcatcgagcgcggcgcggtgggcctgtgctgccagaccgtcggcgaggccgaggcctatgtggcgggcgggatccaggacgtgttggtcaccgccccctccccgccctggggcgcggcgcggctggcggcgctggccaagaccggcgcgcggatcggcgcggtcgccgacgacgagggccagatcgatcggctgtcggacgcggccgtcgcggccggcgtgacgctggacctcgtggtggatctggatctcggcacccaccgcgccggcgcctatccgaaggacgccctgcggctggcgcgcgccgccgacgctgcgcccgggctgcggttcgccgggctgcaggcctatctgggccacctccagcacatggacgaccttgacctgcgcaagtcggccgacgaagccgccttcgccaccctgaaggcgctggtcgccgagctgaccgaagcaggccttcccccgccggttgtgaccggcggcggcaccggcacccacatctatgacctggcctccggcgtctatactgaactacaggccggctcttacgcggtgatggatgtcgagtacgacgcctgcggcgcgccgggcgggcaggcctggggcttcgagccggcgatggccatcgccgccacggtggtctcggccaaccacaagagccatgtcaccgtcgacgccggcttcaaggccgtgtcgatggacggtccccccgcccgtgtcgtggcgggcgccgcgccgggctcgctctggcgggccatgggcgacgagcatggcatgatcgcccacctgagcctgatcgacgtgctgaaggccggcggccgcgatccactgggcttcgacaaggccgtcgccgaagccgacgccgatccggcccgcgcctggcccgccgacgcgccgagggtcggcgacatcgtctggctgcaaccgggccactgcgacccgaccatcaacctctatgacgccctgcatgtctgggacggcgagactctggagcgctgggcggtggatgggagaagggtgtccaaataa

SEQ ID NO: 484 - protein, 369 aa, Unknown
  Obtained from environmental sample
  DOMAIN (1)...(217): Alanine racemase, N-terminal domain
MQALCDAAGVRLRAHGKTHKCSTLGRLIIERGAVGLCCQTVGEAEAYVAGGIQDVLVTAPSPPWGAARLAALAKTGARIGAVADDEGQIDRLSDAAVAAGVTLDLVVDLDLGTHRAGAYPKDALRLARAADAAPGLRFAGLQAYLGHLQHMDDLDLRKSADEAAFATLKALVAELTEAGLPPPVVTGGGTGTHIYDLASGVYTELQAGSYAVMDVEYDACGAPGGQAWGFEPAMAIAATVVSANHKSHVTVDAGFKAVSMDGPPARVVAGAAPGSLWRAMGDEHGMIAHLSLIDVLKAGGRDPLGFDKAVAEADADPARAWPADAPRVGDIVWLQPGHCDPTINLYDALHVWDGETLERWAVDGRRVSK

SEQ ID NO: 485 - DNA, 1089 bp, Unknown
  Obtained from environmental sample
  misc_feature (1)..(1089): n is a, c, g, or t
atgagctatccctggcctgatgcgggcacagccctcaatgcgatttcgacgcccatgcccgtcattgatgaggacaggcttgccgccaatatcctcagggcgcaatcctatctggatgcgcacggcaaaactttccggccacatatcaagacgcacaagatacctgccattgccaaacagcagcttcaggcaggtgcgatcggcatcaactgccagaaggtcagcgaggcggaggttttcgcggatgccggtttcgaggacatcctgatcacctacaatattctcggtgcggcaaagctttcgcggttaaaggcgctaaatgcgcgcatcggcaggctgagcgtcgtggccgatagcgccgtgacgattgccggccttgccgatacatttgatgcggcaaggccgctcgccgttctggttgagtgcgacacgggcggcaaacgctgcggtgtgcagacgccagaagcggccttggcgcttgcggaacagatcgtctcggcatcgggcctcatattcaggggcattttgacctatccggcaccgggcggcgccgagatggtggagaagttcattcgcgagaccatggcgttgctcgccacaaagggcatagattgcccggtgcgatccagcggcggctcgccggatttctattccgcccatcttgtagcctccgccaccgaacatcgggcgggcacctatatctataatgaccgttcgatgctgcgtgcagggcattgcagcgctggcgatctcgccatgcatgttctcgcgaccgtcgtctcaaaaccgacggccgaccgggccgtgctggatagcggctccaaggccctgacatcggatcttctgggtttcaatgattatgggctgctcgagggttacgagggcgctaaaatcatctcgctttcggaagaacatgcggttgttgatttgtccggctgcaccggggccaggcccgaaatcggcgatgtggtccaggttgtaccgaaccacacctgcgttgtcagcaatcttttcgaccgcatggtgttccatcgaaacggcgttgtaacccgggtagagcaggtggcggcacggggaacagtctggtaa

SEQ ID NO: 486 - protein, 362 aa, Unknown
  Obtained from environmental sample
  DOMAIN (17)...(240): Alanine racemase, N-terminal domain
  misc_feature (1)..(362): Xaa is any amino acid
MSYPWPDAGTALNAISTPMPVIDEDRLAANILRAQSYLDAHGKTFRPHIKTHKIPAIAKQQLQAGAIGINCQKVSEAEVFADAGFEDILITYNILGAAKLSRLKALNARIGRLSVVADSAVTIAGLADTFDAARPLAVLVECDTGGKRCGVQTPEAALALAEQIVSASGLIFRGILTYPAPGGAEMVEKFIRETMALLATKGIDCPVRSSGGSPDFYSAHLVASATEHRAGTYIYNDRSMLRAGHCSAGDLAMHVLATVVSKPTADRAVLDSGSKALTSDLLGFNDYGLLEGYEGAKIISLSEEHAVVDLSGCTGARPEIGDVVQVVPNHTCVVSNLFDRMVFHRNGVVTRVEQVAARGTVW

SEQ ID NO: 487 - DNA, 1146 bp, Unknown
  Obtained from environmental sample
  misc_feature (1)..(1146): n is a, c, g, or t
atgacaaacgccgacgcgatcagtaagatttccacccctagcctcattgttgacgaagcacgcatgttgcggaacatctccagattgcagcggcatctcgacagtttgaacgtctcgatacgtccgcacctcaagacggtgaaatcggttgatgccgcgaagcgtatcctctcgagcggcaacggtccggctaccgtctcgacgctgaaggaggcggaagttttcgcgtcggcaggcgtgcgggatatcctctatgccgtcggcatcgggccgcaaaaactggaccgggtgcttgcgcttcgtgctggcggctgcgatctttccgtcgtgctggacacgcccgaacaagcaagagccgtggttgaggcctcccgccgggcgaaagatggcatccctgcgttgattgagattgactcggatggtcaccgcgcgggtttgaagccggacgatcccgccttgatcgatattggccgtatcttgcacgaggaaggcgctgtgctgcgcggtgtcgttactcacgccggcgaaagctatggcgtggtgggtgccgaagcgctggccgccttcgcggagcgcgagcgcctggctgccgtcactgcggcggaagccttgagagccgcaggactgccttgtccgacggtcagtgtcggttcgacgccgacagcccatttcgcccgtgatctgtccggcgtcacggaagtcagggccggggtatatgtcttttttgatctcgttatggctggcattggcgtctgcagcttggacgatatcgcgctttccgtgctgacgacagtgatcggccatcagaaggaacgcggctggattattgtggatgccggctggatggccctgtcgcgtgatcgcggcacggcgagccaggcggtcgatcaggcatatggcgtcgtttgtgacattcatggcgatgtgattgacgatctgatcgttaaatccgcgaaccaggaacatggtattctggctctgaggcctggaagctcggcacgtttgccagattttccgcttggaacccagcttcgcattttgcccaatcatgcctgcgccactggtgcgcaattcgccagctatacggtgctgccagctggcggctccacgacgcttgcccagtggccccgcttcagcggctggtaa

SEQ ID NO: 488 - protein, 381 aa, Unknown
  Obtained from environmental sample
  DOMAIN (12)...(246): Alanine racemase, N-terminal domain
  misc_feature (1)..(381): Xaa is any amino acid
MTNADAISKISTPSLIVDEARMLRNISRLQRHLDSLNVSIRPHLKTVKSVDAAKRILSSGNGPATVSTLKEAEVFASAGVRDILYAVGIGPQKLDRVLALRAGGCDLSVVLDTPEQARAVVEASRRAKDGIPALIEIDSDGHRAGLKPDDPALIDIGRILHEEGAVLRGVVTHAGESYGVVGAEALAAFAERERLAAVTAAEALRAAGLPCPTVSVGSTPTAHFARDLSGVTEVRAGVYVFFDLVMAGIGVCSLDDIALSVLTTVIGHQKERGWIIVDAGWMALSRDRGTASQAVDQAYGVVCDIHGDVIDDLIVKSANQEHGILALRPGSSARLPDFPLGTQLRILPNHACATGAQFASYTVLPAGGSTTLAQWPRFSGW

SEQ ID NO: 489 - DNA, 1614 bp, Unknown
  Obtained from environmental sample
atgtttactatgatttttatgaaaaaaaaattttgcctattgtttgcaacgattattctgtttattacgtgtctatgttttttgttaaaaagcgtctcagaaacaaatctgcataaaaaaataaatattgaaatgcattttgataacttagtgtctaattttgaaaaaattagaaaattaaacaacgaaaatgttgatgtagctgataaagtaataccggtcgtaaaggcaaatgcatataattttggagtttatgacatcactaagacttttttatcaatgaaagaaccacaaacaaagttttttgtttttagtctggaagaaggcattgagctcaggaaattttttccatccatagagagaatatttgtaataatgggggctctggaaaacgacgcggagttatttaaaaaatataacttaactcctgttgtaaattctttttatcagctggaagtgtgcaaaaagcataacattaaaaacattgtattacagtttaatacagggatgaatagaaatggatttgaagtaaaagaattaagaaaagttaaacaaatttgtgatagtgaaaaatttaatgtattaatggtaatgagccattttgcttgtagcgacaatatggccagtgaagtcaatgcatatcaaataaatgaatataaaaaagtggcacgagtttttaatgataaaaagattattaaatcttttcctgcaacttttggtatattaaattttaatactataaatggattagttaactcttttagacccggaagattatattatggatttcttccaaaagaaggatatgataaaaatttgttttctgtttatgtttatctaagtaaagataaagaaggaaatattattttgccgttcggtaaagaagatggtattgactatggtgagcaagcatatattttagtggataaaaataaggcatatgtaaagcaagtagatagtcataaagtaatattagatacaaacgataaaacattagttggcaaaaaagtatatctaataaaaaatggtatgggatatgatgagtttaaagaacaatctaaacaagacctgctaactttttttggaaaaatctttaaaaattgcgataaaaataaaaatttatgcaatatcaatgcaacaaggaagagagccaaaaaagacaataaatttgttccaaaagcaatatttaaaaaggatgcgaaaggacaatatactcaatatacaactactttatttgagaaacgagaagttagtgctgacggtattgttggatatgatgcaacaagagctgtaaaaaaaggtgacaagttaggtgtaatttttaatggtcatatggatggtttttatcagcctatgagtaataaacatgtgtttgtttatgtgaaaaacaaatacaaacaacttataccttgtgaattttatggtttgatttcttccgatcaggctgtaattaaaattcctaatgatgagtttgataatatagagtatggtgcaaaggttgtggtttttgacaaaaatcacccaataacattatttgagcaagcaacaggtgtttcaagagatgaattattttatggattagataagacatatagaatagcagaacaaaaatag

SEQ ID NO: 490 - protein, 537 aa, Unknown; identical to SEQ ID NO: 62
  Obtained from an environmenal sample

SEQ ID NO: 491 - DNA, 1230 bp, Unknown
  Obtained from an environmental sample
atgccgttttgccgtaccctcctggccgtatcgctgggcctgctgatcaccggccaggccccgctgtacgctgcgccaccgctgtcgatggacaacggcaccaacgccctgaccgtgcagaacagcaacgcctgggttgaagtcagcgccagcgctctgcaacacaacatccgcaccctgcagacagagttgggtggcaagtccaaactgtgcgccgtgctcaaggccgacgcctatggccacggcattggcctggtgatgccatcgatcattgcccagggcgtgccctgcgtggcggtggccagcaacgaagaggcccgcgtggttcgcgccagcggctttaccgggcaactggtgcgggtacgcctggccagcctcagcgagctggaagacgccctgcaatacgacatggaggaactggtcggcagcgccgagttcgcccgccaggtcgatgccatcgccgcgcgccacggcaagacgctgcgcatccacatggcgctcaactccagcggcatgagccgcaacggcgtagagatggccacctggtccggccgtggcgaagcgctgcagatcactgaccagaagcacctcaagctggtcgcgctgatgacccacttcgccgtggaagacaaggacgatgtgcgcaagggcctggcggcgttcaatgagcaggccgactggctgatcaagcacgccaagcttgaccgcagcaaggtcaccctgcacgcggccaactcgttcgctacgctggaggtgccggaagcgcgcctggacatggtgcgtaccggtggcgcgctgttcggtgacaccgtgccggcgcgcaccgaatacaaacgtgccatgcagttcaagtcgcacgtggcggcggtgcacagctacccggccggcaacaccgtcggctacgaccgcaccttcaccctggcccgcgattcgcgcctggccaacatcaccgtcggctactccgacggctaccgccgggtcttcaccaacaagggccatgtgctgatcaacggccatcgcgtgccggtggtgggcaaggtttcgatgaacacgctgatggtcgatgtcaccgacttcccggacgtgaagggtggcaacgaagtggtgctgtttggcaagcaggccgggtctgaaatcacccaggccgaaatggaagaaatcaacgatgcgctgctcgccgacctgtacaccgtgtggggcagtgccaacccgaaaattctcgtcgactaa

SEQ ID NO: 492 - protein, 409 aa, Unknown; identical to SEQ ID NO: 42
  Obtained from an environmental sample

SEQ ID NO: 493 - DNA, 1230 bp, Unknown
  Obtained from an environmental sample
atgccattctcccgtacacttctggccgtatcgctgggcctgctgatcaccggccaggccccgctgtacgctgcgccaccgctgtcgatggacaacggcaccaacgccctgaccgtgcagaacagcaacgcctgggttgaagtcagcgccagcgctctgcaacacaacatccgcaccctgcagacagagttgggtggcaagtccaaactgtgcgccgtgctcaaggccgacgcctatggccacggcatcggcctggtgatgccatcgatcattgcccagggcgtgccctgcgtggcggtggccagcaacgaagaggcccgcgtggttcgcgccagcggctttaccgggcaactggtgcgggtacgcctggccagcctcagcgagctggaagacgccctgcaatacgacatggaagaactggtcggcagcgccgagttcgcccgccaggtcgatgccatcgccgcgcgccacggcaagacgctgcgcatccacatggcgctcaactccagcggcatgagccgcaacggcgtagagatggccacctggtccggccgtggcgaagcgctgcagatcactgaccagaagcacctcaagctggtcgcgctgatgacccacttcgccgtggaagacaaggacgatgtgcgcaagggcctggcggcgttcaatgagcaggccgactggctgatcaagcacgccaagcttgaccgcagcaaggtcaccctgcacgcggccaactcgttcgctacgctggaggtgccggaagcgcgcctggacatggtgcgtaccggtggcgcgctgttcggtgacaccgtgccggcgcgcaccgaatacaaacgtgccatgcagttcaagtcgcacgtggcggcggtgcacagctacccggccggcaacaccgtcggctacgaccgcaccttcaccctggcccgcgattcgcgcctggccaacatcaccgtcggctactccgacggctaccgccgggtcttcaccaacaagggccatgtgctgatcaacggccatcgcgtgccggtggtgggcaaggtttcgatgaacacgctgatggtcgatgtcaccgacttcccggacgtgaagggtggcaacgaagtggtgctgtttggcaagcaggccgggtctgaaatcacccaggccgaaatggaagaaatcaacgatgcgctgctcgccgacctgtacaccgtgtggggcagtgccaacccgaaaattctcgtcgactaa

SEQ ID NO: 494 - protein, 409 aa, Unknown; identical to SEQ ID NO: 46
  Obtained from an environmental sample

SEQ ID NO: 495 - DNA, 1230 bp, Unknown
  Obtained from an environmental sample
atgccattttcccgtaccctcctggccgtatcgctgggcctgctgatcaccggccaggccccgctgtacgctgcgccaccgctgtcgatggacaacggcaccaacgccctgaccgtgcagaacagcaacgcctgggttgaagtcagcgccagcgctctgcaacacaacatccgcaccctgcagacagagttgggtggcaagtccaaactgtgcgccgtgctcaaggccgacgcctatggccacggcattggcctggtgatgccatcgatcattgcccagggcgtgccctgcgtggcggtggccagcaacgaagaggcccgcgtggttcgcgccagcggctttaccgggcaactggtgcgggtacgcctggccagcctcagcgagctggaagacgccctgcaatacgacatggaagaactggtcggcagcgccgagttcgcccgccaggtcgatgccatcgccgcgcgccacggcaagacgctgcgcatccacatggcgctcaactccagcggcatgagccgcaacggcgtagagatggccacctggtccggccgtggcgaagcgctgcagatcactgaccagaagcacctcaagctggtcgcgctgatgacccacttcgccgtggaagacaaggacgatgtgcgcaagggcctggcggcgttcaatgagcaggccgactggctgatcaagcacgccaagcttgaccgcagcaaggtcaccctgcacgcggccaactcgttcgctacgctggaggtgccggaagcgcgcctggacatggtgcgtaccggtggcgcgctgttcggtgacaccgtgccggcgcgcaccgaatacaaacgtgccatgcagttcaagtcgcacgtggcggcggtgcacagctacccggccggcaacaccgtcggctacgaccgcaccttcaccctggcccgcgattcgcgcctggccaacatcaccgtcggctactccgacggctaccgccgggtcttcaccaacaagggccatgtgctgatcaacggccatcgcgtgccggtggtgggcaaggtttcgatgaacacgctgatggtcgatgtcaccgacttcccggacgtgaagggtggcaacgaagtggtgctgtttggcaagcaggccgggtctgaaatcacccaggccgaaatggaagaaatcaacgatgcgctgctcgccgacctgtacaccgtgtggggcagtgccaacccgaaaattctcgtcgactaa

SEQ ID NO: 496 - protein, 409 aa, Unknown; identical to SEQ ID NO: 46
  Obtained from an environmental sample

SEQ ID NO: 497 - DNA, 1230 bp, Unknown
  Obtained from an environmental sample
atgccatttcgccgtaccctcctcgccctgtccctcggtctcgtgctctggcaaggccaggtacatgcggcgccgccgatgtcgctggacaacggcacttcgcagctgaccgcgcaggtcagcaacgcctgggtggagatcaacaagactgccttcgagcacaacatccgcaccctgcaggcggagctcagtggcaagtcgaagctgtgcgcggtgctcaaggcggatgcctacggccacggcatcggcctgctgatgccgtcggtgatcgccatggacgtgccctgcgtcgccatcgccagcaacgaagaagcgcgggtggtgcgggccagcggcttcaagggcgaactggtgcgggtacgtaccggctccctggcggaagtcgaggatgccctcaagtacaacgtcgaggaactggtcggcaatgccgagttcgcccaccaggcgggcgagattgccgcgcgtcaaggccgcaagctgcgtgtgcacatcgcgttgaactccagcggcatgagtcgcaacgggctggaaatggaaagcgagcaaggccgccgcgacgccgtggccgttgcgaaggaaaagaaccccgaagtggtggcgatcatgacccactacgcggtggaggatcgcgaggatgtgctgaagggactggcggcgttcaaccggcaggccgactggctgatcaaggaagctggactggaccgcagcaagctgaccctgcacaccgccaactccttcgccaccctggaagtccccgaggcgcgcctggacatggtgcgtaccggcggtgcgctgttcggcgacaccgtggtcacccgcaccgagtacaagcgggtgatgcagttcaagtcgcacgtggcttcggtgaacgcctacccggcgggcaacagcgtcggctatgaccgcacctacaccatcaaccgcgactcgcggctggccaacatcaccgtcggctactccgatggctaccggcgggtattcaccaacaagggccatgtgctgatcgacggccaccgcgtgccggtggtgggcaaggtttcgatgaacaccctgatggttgacgtcaccgacttcccggacgtgaaggccggcgacgaagtggtgctgttcggcaagcagggcggcagcgagattgcccagagcgagatggaagacatcaatggtgcgctgctggccgacctgtacacggtctggggtagcgccaatccgaaagtgctggtcgagcaataa

SEQ ID NO: 498 - protein, 409 aa, Unknown; identical to SEQ ID NO: 52
  Obtained from an environmental sample

SEQ ID NO: 499 - protein, 21 aa, Artificial sequence
  Consensus leader sequence
MHKKTLLATLIFGLLAGQAVA

SEQ ID NO: 500 - protein, 21 aa, Artificial sequence
  Consensus leader sequence
MHKKTLLATLILGLLAGQAVA

SEQ ID NO: 501 - protein, 21 aa, Artificial sequence
  Consensus leader sequence
  misc_feature (12)..(12): Xaa can be any amino acid
MHKKTLLATLIXGLLAGQAVA

SEQ ID NO: 502 - protein, 24 aa, Artificial sequence
  Leader sequence for P. putida KT2440 BAR
MPFRRTLLAASLALLITGQAPLYA

SEQ ID NO: 503 - DNA, 31 bp, Artificial sequence
  FNco1 restriction site
ggttccggaaccatggccgaaacaaatctgc

SEQ ID NO: 504 - DNA, 44 bp, Artificial sequence
  RXho1 with stop restriction site
ggttccaaggctcgagctatttttgttctgctattctatatgtc

SEQ ID NO: 505 - DNA, 41 bp, Artificial sequence
  RXho1 restriction site
ggttccaaggctcgagtttttgttctgctattctatatgtc

SEQ ID NO: 506 - DNA, 36 bp, Artificial sequence
  Primer
ggccttaactcgaggcggttgatcttcttggggttg

SEQ ID NO: 507 - DNA, 37 bp, Artificial sequence
  Primer
ggccttaacatatggctccctatctgccccttgtgac

SEQ ID NO: 508 - DNA, 34 bp, Artificial sequence
  Primer
ccttggaactcgagttagcggttgatcttcttgg

SEQ ID NO: 509 - DNA, 32 bp, Artificial sequence
  Primer
ggccttaacatatggccccttacctgccgctg

SEQ ID NO: 510 - DNA, 43 bp, Artificial sequence
  Primer
ccggaaccttggaaccgtcgacttagcgtttgatcttcttggg

SEQ ID NO: 511 - DNA, 46 bp, Artificial sequence
  Primer
ggccttaaccttgtcgacgcgtttgatcttcttggggttggtgtag

SEQ ID NO: 512 - DNA, 38 bp, Artificial sequence
  Primer
ggccttaacatatggctccaccgctgtcgatggacaac

SEQ ID NO: 513 - DNA, 41 bp, Artificial sequence
  Primer
ggccttaacatatggctagcaatgcctgggtggagatagac

SEQ ID NO: 514 - DNA, 39 bp, Artificial sequence
  Primer
ggccttaactcgagttaggtgttgccccagacggtgtac

SEQ ID NO: 515 - DNA, 42 bp, Artificial sequence
  Primer
ggccttaactcgagggtgttgccccagacggtgtacatgtcc

SEQ ID NO: 516 - DNA, 32 bp, Artificial sequence
  Primer
cgccatcatgaaggcgaacgcctacggtcacg

SEQ ID NO: 517 - DNA, 38 bp, Artificial sequence
  Primer
taagaaggagatatacatatggaattcgattggattcg

SEQ ID NO: 518 - DNA, 37 bp, Artificial sequence
  Primer
ggtggtggtgctcgagtgcggccgcttataacacctg

SEQ ID NO: 519 - DNA, 39 bp, Artificial sequence
  Primer
taagaaggagatatacatatgtcgcattccaccacctgg

SEQ ID NO: 520 - DNA, 37 bp, Artificial sequence
  Primer
ggtggtggtgctcgagtgcggccgctcagcgatactg

SEQ ID NO: 521 - DNA, 40 bp, Artificial sequence
  Primer
taagaaggagatatacatatgaaaagtgcaggcattatag

SEQ ID NO: 522 - DNA, 37 bp, Artificial sequence
  Primer
ggtggtggtgctcgagtgcggccgcttaagccttagt

SEQ ID NO: 523 - DNA, 38 bp, Artificial sequence
  Primer
ggttccaacatatgaccgggctgacggtaacggcggtg

SEQ ID NO: 524 - DNA, 35 bp, Artificial sequence
  Primer
ggttccaactcgagataatagcggccgctcatccc

SEQ ID NO: 525 - DNA, 39 bp, Artificial sequence
  Primer
taagaaggagatatacatatgagaccagctcgcgttagc

SEQ ID NO: 526 - DNA, 37 bp, Artificial sequence
  Primer
ggtggtggtgctcgagtgcggccgcctagttccagtt

SEQ ID NO: 527 - DNA, 36 bp, Artificial sequence
  Primer
ggttccaaggcatatgagaacgagacatcgatgctg

SEQ ID NO: 528 - DNA, 38 bp, Artificial sequence
  Primer
ggttccaattctcgagtcaggctgcgtgactgccgcga

SEQ ID NO: 529 - DNA, 37 bp, Artificial sequence
  Primer
ttccaattggcatatgcaccgcgtctgggctgaaatc

SEQ ID NO: 530 - DNA, 37 bp, Artificial sequence
  Primer
ggttccaactcgagtcacacatacacacgcgccacgc

SEQ ID NO: 531 - DNA, 36 bp, Artificial sequence
  Primer
ttggaaccttcatatgcaaacgaaacccgcgccccg

SEQ ID NO: 532 - DNA, 40 bp, Artificial sequence
  Primer
ggttccaaggctcgagttagcgaatgtaaacccgttccac

SEQ ID NO: 533 - DNA, 36 bp, Artificial sequence
  Primer
ccttggaacatatggaacgaatcgtccagaagctgc

SEQ ID NO: 534 - DNA, 34 bp, Artificial sequence
  Primer
ggccttaactcgagttatgacatccgcggaatcc

SEQ ID NO: 535 - DNA, 36 bp, Artificial sequence; identical to SEQ ID NO: 533
  Primer

SEQ ID NO: 536 - DNA, 34 bp, Artificial sequence; identical to SEQ ID NO: 534
  Primer

SEQ ID NO: 537 - DNA, 36 bp, Artificial sequence; identical to SEQ ID NO: 533
  Primer

SEQ ID NO: 538 - DNA, 34 bp, Artificial sequence; identical to SEQ ID NO: 534
  Primer

SEQ ID NO: 539 - DNA, 36 bp, Artificial sequence; identical to SEQ ID NO: 533
  Primer

SEQ ID NO: 540 - DNA, 34 bp, Artificial sequence; identical to SEQ ID NO: 534
  Primer

SEQ ID NO: 541 - DNA, 23 bp, Artificial sequence
  Primer
gccagcaacgargargcmcgcgt

SEQ ID NO: 542 - DNA, 18 bp, Artificial sequence
  Primer
tggccstkgatcagcaca

SEQ ID NO: 543 - DNA, 1227 bp, A. caviae
atgcacaagaaaacactgctcgcgaccctgatctttggcctgctggccggccaggcagtcgccgccccctatctgccgctcgccgacgaccaccgcaacggtcaggaacagaccgccgccaacgcctggctggaagtggatctcggcgccttcgagcacaacatccagaccctgaagaatcgcctcggtgacaagggcccgcagatctgcgccatcatgaaggcggacgcctacggtcacggcatcgacctgctggtcccttccgtggtcaaggcaggcatcccctgcatcggcatcgccagcaacgaagaagcacgtgttgcccgcgagaagggcttcgaaggtcgcctgatgcgggtacgtgccgccaccccggatgaagtggagcaggccctgccctacaagctggaggagctcatcggcagcctggagagcgccaaggggatcgccgacatcgcccagcgccatcacaccaacatcccggtgcacatcggcctgaactccgccggcatgagccgcaacggcatcgatctgcgccaggacgatgccaaggccgatgccctggccatgctcaagctcaaggggatcaccccggtcggcatcatgacccacttcccggtggaggagaaagaggacgtcaagctggggctggcccagttcaagctggactaccagtggctcatcgacgccggcaagctggatcgcagcaagctcaccatccacgccgccaactccttcgccaccctggaagtaccggaagcctactttgacatggtgcgcccgggcggcatcatctatggcgacaccattccctcctacaccgagtacaagaaggtgatggcgttcaagacccaggtcgcctccgtcaaccactacccggcgggcaacaccgtcggctatgaccgcaccttcaccctcaagcgcgactccctgctggccaacctgccgatgggctactccgacggctaccgccgcgccatgagcaacaaggcctatgtgctgatccatggccagaaggcccccgtcgtgggcaagacttccatgaacaccaccatggtggacgtcaccgacatcaaggggatcaaacccggtgacgaggtggtcctgttcggacgccagggtgatgccgaggtgaaacaatctgatctggaggagtacaacggtgccctcttggcggacatgtacaccgtctggggctataccaaccccaagaagatcaagcgctaa

SEQ ID NO: 544 - protein, 408 aa, A. caviae
MHKKTLLATLIFGLLAGQAVAAPYLPLADDHRNGQEQTAANAWLEVDLGAFEHNIQTLKNRLGDKGPQICAIMKADAYGHGIDLLVPSVVKAGIPCIGIASNEEARVAREKGFEGRLMRVRAATPDEVEQALPYKLEELIGSLESAKGIADIAQRHHTNIPVHIGLNSAGMSRNGIDLRQDDAKADALAMLKLKGITPVGIMTHFPVEEKEDVKLGLAQFKLDYQWLIDAGKLDRSKLTIHAANSFATLEVPEAYFDMVRPGGIIYGDTIPSYTEYKKVMAFKTQVASVNHYPAGNTVGYDRTFTLKRDSLLANLPMGYSDGYRRAMSNKAYVLIHGQKAPVVGKTSMNTTMVDVTDIKGIKPGDEVVLFGRQGDAEVKQSDLEEYNGALLADMYTVWGYTNPKKIKR

SEQ ID NO: 545 - DNA, 38 bp, Artificial sequence
  Primer
ggaaccttcatatgcacaagaaaacactgctcgcgacc

SEQ ID NO: 546 - DNA, 39 bp, Artificial sequence
  Primer
ggttccaaggatccttagcgcttgatcttcttggggttg

SEQ ID NO: 547 - DNA, 39 bp, Artificial sequence
  Primer
ttccaaggctcgaggcgcttgatcttcttggggttggta

SEQ ID NO: 548 - DNA, 31 bp, Artificial sequence
  Primer
ccttggaacatatggccccctatctgccgct

SEQ ID NO: 549 - DNA, 32 bp, Artificial sequence; identical to SEQ ID NO: 516
  Primer

What is claimed is:

1. An isolated, synthetic, or recombinant polypeptide or peptide having a racemase activity, selected from a group consisting of:
   (a) full length amino acid sequence having at least 95%, 96%, 97%, 98%, 99%, or 100% sequence identity to the full length amino acid sequence of SEQ ID NO:412,
   (b) an amino acid sequence encoded by a full length nucleic acid sequence of SEQ ID NO:411;
   (c) the amino acid sequence of any of (a) to (b), and comprising at least one amino acid residue conservative substitution, and the polypeptide or peptide retains racemase activity; wherein the conservative substitution comprises replacement of an aliphatic amino acid with another aliphatic amino acid; replacement of a serine with a threonine or vice versa; replacement of an acidic residue with another acidic residue; replacement of a residue bearing an amide group with another residue bearing amide group; exchange of a basic residue with another basic residue; or, replacement of an aromatic residue with another aromatic residue, or a combination thereof,
   (d) the amino acid sequence of (c), wherein the aliphatic residue comprises Alanine, Valine, Leucine, Isoleucine or a synthetic equivalent thereof; the acidic residue comprises Aspartic acid, Glutamic acid or a synthetic equivalent thereof; the residue comprising an amide group comprises Aspartic acid, Glutamic acid or a synthetic equivalent thereof; the basic residue comprises Lysine, Arginine or a synthetic equivalent thereof; or, the aromatic residue comprises Phenylalanine, Tyrosine or a synthetic equivalent thereof;
   (e) the polypeptide of any of (a) to (d) but lacking a signal sequence, a prepro domain, or other domain;
   (f) the polypeptide of any of (a) to (e) and further comprising a heterologous sequence;
   (g) the polypeptide of (f), wherein the heterologous sequence comprises: (A) a heterologous signal sequence, a heterologous domain, a heterologous dockerin domain, a heterologous catalytic domain (CD), or a combination thereof; (B) the sequence of (A), wherein the heterologous signal sequence, domain or catalytic domain (CD) is derived from a heterologous enzyme; or, (C) a tag, an epitope, a targeting peptide, a cleavable sequence, a detectable moiety or an enzyme; or
   (h) the polypeptide of any of (a) to (g), wherein the polypeptide is glycosylated or comprises at least one glycosylation site or further comprises a polysaccharide, wherein optionally the glycosylation is an N-linked glycosylation, and optionally the polypeptide is glycosylated after being expressed in a *P. pastoris* or a *S. pombe*.

2. A beverage, feed, food, food or feed additive, food or feed supplement, or dietary aid comprising the amino acid sequence of claim 1, wherein optionally, the feed, food, food or feed additive, food or feed supplement, or dietary aid further comprises a carrier selected from the group consisting of a grain germ, a grain germ that is spent of oil, a hay, an alfalfa, a timothy, a soy hull, a sunflower seed meal and a wheat midd, and optionally the carrier comprises grain germ that is spent of oil, or optionally the racemase, is glycosylated to provide thermostability at pelletizing conditions, and optionally the delivery matrix is formed by pelletizing a mixture comprising a grain germ and an isomerase, a racemase, an amino acid racemase, an alanine racemase, or an epimerase, and optionally the pelletizing conditions include application of steam, and optionally the pelletizing conditions comprise application of a temperature in excess of about 80° C. for about 5 minutes and the enzyme retains a specific activity of at least 350 to about 900 units per milligram of enzyme.

3. A composition comprising an organic material comprising a polypeptide having the amino acid sequence of claim 1, wherein optionally the organic material is a biomass, wood, a wood pulp, a Kraft pulp, a paper, a paper product or a paper pulp, and wherein optionally, the biomass, wood, wood pulp, Kraft pulp, paper, paper product or paper pulp comprises a softwood and hardwood, or the wood, wood pulp, Kraft pulp, paper or paper pulp is derived from a softwood and hardwood.

4. A waste treatment solution comprising a polypeptide having the amino acid sequence of claim 1.

5. An enzyme mixture or cocktail comprising (a) the enzyme of claim 1, and one or more other enzyme(s); (b) the mixture or cocktail of (a), wherein the one or more other enzyme(s) is an isomerase, racemase, amino acid racemase, alanine racemase, epimerase, a mannanase, a glucanase, cellulases, lipases, esterases, proteases, or endoglycosidases, endo-beta.-1,4-glucanases, beta-glucanases, endo-beta-1,3 (4)-glucanases, cutinases, peroxidases, catalases, laccases, amylases, glucoamylases, pectinases, transferases, transaminases, amino transferases, dehydrogenases, oxidoreductases, reductases, oxidases, phenoloxidases, ligninases, pullulanases, arabinanases, hemicellulases, xyloglucanases, xylanase, pectin acetyl esterases, rhamnogalacturonan acetyl esterases, polygalacturonases, rhamnogalacturonases, galactanases, pectin lyases, pectin methylesterases, cellobiohydrolases or transglutaminases.

6. A composition comprising the polypeptide of claim 1.

7. An isolated, synthetic, or recombinant polypeptide having a racemase activity, wherein the polypeptide is a full length amino acid sequence of SEQ ID NO:412.

* * * * *

UNITED STATES PATENT AND TRADEMARK OFFICE
CERTIFICATE OF CORRECTION

PATENT NO. : 8,541,220 B2
APPLICATION NO. : 12/810067
DATED : September 24, 2013
INVENTOR(S) : David P. Weiner Page 1 of 1

It is certified that error appears in the above-identified patent and that said Letters Patent is hereby corrected as shown below:

Title page, delete "Mervyn L. De Souza, Ft. Collins, CO (US)" and insert -- Mervyn L. De Souza, Plymouth, MA (US) --, therefor.

Title page, delete "Sherry Kollmann, Rogers, MN (US)" and insert -- Sherry Kollmann, Maple Gove, MN (US) --, therefor.

Signed and Sealed this
Fourth Day of February, 2014

Michelle K. Lee
*Deputy Director of the United States Patent and Trademark Office*